(12) United States Patent
Damude et al.

(10) Patent No.: US 8,049,062 B2
(45) Date of Patent: Nov. 1, 2011

(54) DELTA-9-ELONGASES AND THEIR USE IN MAKING POLYUNSATURATED FATTY ACIDS

(75) Inventors: Howard Glenn Damude, Hockessin, DE (US); Brian McGonigle, Wilmington, DE (US); Quinn Qun Zhu, West Chester, PA (US); Zhixiong Xue, Chadds Ford, PA (US)

(73) Assignee: E.I. du Pont de Nemours and Company, Wilmington, DE (US)

( * ) Notice: Subject to any disclaimer, the term of this patent is extended or adjusted under 35 U.S.C. 154(b) by 604 days.

(21) Appl. No.: 11/992,899

(22) PCT Filed: Nov. 16, 2006

(86) PCT No.: PCT/US2006/044676
§ 371 (c)(1),
(2), (4) Date: Mar. 27, 2008

(87) PCT Pub. No.: WO2007/061845
PCT Pub. Date: May 31, 2007

(65) Prior Publication Data
US 2009/0119795 A1   May 7, 2009

Related U.S. Application Data

(60) Provisional application No. 60/739,989, filed on Nov. 23, 2005.

(51) Int. Cl.
*A01H 1/00* (2006.01)
*A01H 5/00* (2006.01)
*A01H 5/10* (2006.01)
*C12N 5/14* (2006.01)

(52) U.S. Cl. ........ 800/278; 800/281; 800/295; 800/306; 800/312; 800/314; 800/320.1; 435/410; 435/468

(58) Field of Classification Search ........................ None
See application file for complete search history.

(56) References Cited

U.S. PATENT DOCUMENTS

| | | | |
|---|---|---|---|
| 6,075,183 A | 6/2000 | Knutzon et al. | |
| 6,403,349 B1 | 6/2002 | Mukerji et al. | |
| 6,459,018 B1 | 10/2002 | Knutzon | |
| 6,677,145 B2 | 1/2004 | Mukerji et al. | |
| 6,825,017 B1 | 11/2004 | Browse et al. | |
| 7,714,185 B2 * | 5/2010 | Napier et al. .................. | 800/281 |
| 2004/0111763 A1 | 6/2004 | Heinz et al. | |
| 2004/0253621 A1 | 12/2004 | Picataggio et al. | |
| 2006/0094092 A1 | 5/2006 | Damude et al. | |
| 2006/0110806 A1 | 5/2006 | Damude et al. | |
| 2006/0115881 A1 | 6/2006 | Damude et al. | |
| 2006/0195939 A1 | 8/2006 | Damude et al. | |

FOREIGN PATENT DOCUMENTS

| | | |
|---|---|---|
| WO | WO 98/46764 | 10/1998 |
| WO | WO 98/55625 | 12/1998 |
| WO | WO 00/12720 | 3/2000 |
| WO | WO 00/34439 | 6/2000 |
| WO | 02/26946 | 4/2002 |
| WO | 02/077213 | 10/2002 |
| WO | WO 02/077213 | * 10/2002 |
| WO | WO2004/057001 | 7/2004 |
| WO | WO 2004/057001 | * 7/2004 |
| WO | WO2004/071178 | 8/2004 |
| WO | WO2004/071467 | 8/2004 |
| WO | WO2004/090123 | 10/2004 |
| WO | WO2004/101753 | 11/2004 |
| WO | WO2004/101757 | 11/2004 |

OTHER PUBLICATIONS

Browse et al., Trends in Biochemical Sciences, Polyunsaturated fatty acid synthesis: what will they think of next? vol. 27(9), pp. 467-473, 2002.
Napier, Trends in Plant Sciences, Plumbing the depths of PUFA biosynthesis: a novel polyketide synthase-like pathway from marine organisms, vol. 7(2), pp. 51-54, 2002.
Spychalla et al., Proc. Natl. Acad. Sci. USA, Identification of an animal w-3 fatty acid desaturase by heterologous expression in arabidopsis, vol. 94, pp. 1142-1147, 1997.
National Center for Biotechnology Information General Identifier No. 17226123, Accession No. AAL37626, Mar. 9, 2006, Qi et al., Identification of a cDNA encoding a novel C18-Delta(9) polyunsaturated fatty acid-specific elongating activity from the docosahexaenoic acid (DHA)-producing microalga, *Isochrysis galbana*.
Qi et al., FEBS Lett., Identification of a cDNA encoding a novel C18-Delta(9) polyunsaturated fatty acid-specific elongating activity from the docosahexaenoic acid (DHA)-producing microalga, *Isochrysis galbana*, vol. 510(3), pp. 159-165, 2002.
Smith et al., Planta, Heterologous expression of a fatty acid hydroxylase gene in developing seeds of *Arabidopsis thaliana*, vol. 217, pp. 507-516, 2003.
National Center for Biotechnology Information General Identifier No. 86565568, Accession No. NM_068396, The *C. elegans* Sequencing Consortium, Mar. 23, 2007.
National Center for Biotechnology Information General Identifier No. 21899501, Accession No. AX464731, Jul. 16, 2002, Elongase Genes and Uses Thereof. P. Mukerji et al.
National Center for Biotechnology Information General Identifier No. 30690063, Accession No. NM_119617, Apr. 20, 2007.
National Center for Biotechnology Information General Identifier No. 31981652, Accession No. NM_134255, Jun. 3, 2007, The Status, Quality and Expansion of the NIH Full-Length cDNA Project: Mammalian Gene Collection.
National Center for Biotechnology Information General Identifier No. 148298785, Accession No. NM_134383, Jun. 26, 2007, Identification and Expression of a Rat Fatty Acid Elongase Involved in the Biosynthesis of C18 Fatty Acids. K. Inagaki et al.

(Continued)

*Primary Examiner* — Eileen B O'Hara

(57) ABSTRACT

Isolated nucleic acid fragments and recombinant constructs comprising such fragments encoding delta-9 elongases along with a method of making long-chain polyunsaturated fatty acids (PUFAs) using these delta-9 elongases in plants.

21 Claims, 24 Drawing Sheets

OTHER PUBLICATIONS

National Center for Biotechnology Information General Identifier No. 19705492, Accession No. NM_134382, Nov. 17, 2006, Identification and Expression of a Rat Fatty Acid Elongase Involved in the Biosynthesis of C18 Fatty Acids. K. Inagaki et al.

National Center for Biotechnology Information General Identifier No. 86565567, Accession No. NM_068392, Mar. 23, 2007.

National Center for Biotechnology Information General Identifier No. 86565488, Accession No. NM_070713, Mar. 23, 2007.

National Center for Biotechnology Information General Identifier No. 71985633, Accession No. NM_068746, Mar. 23, 2007.

National Center for Biotechnology Information General Identifier No. 17537430, Accession No. NM_064685, Mar. 23, 2007.

Lassner, et al., A Jojoba Beta-Ketoacyl-Coa Synthase cDNA Complements the Canola Fatty Acid Elongation Mutation in Transgenic Plants, The Plant Cell, vol. 8, pp. 281-292, 1996.

Qi et al., Production of Very Long Chain Polyunsaturated Omega-3 and Omega-6 Fatty Acids in Plants, Nature Biotechnology, vol. 22(6), pp. 739-745, 2004.

Wallis et al., The Delta8-Desaturase of *Euglena* Gracilis: An Alternate Pathway for Synthesis of 20-Carbon Polyunsaturated Fatty Acids, Archives of Biochemistry & Biophysics, vol. 365(2), pp. 307-316, 1999.

Barsanti et al., Fatty Acid Content in Wild Type and wzsl Mutant of *Euglena* Gracilis, Journal of Applied Phycology, vol. 12, pp. 515-520, 2000.

National Center for Biotechnology Information General Identifier No. 17226122, Accession No. AF390174, Qi et al., Identification of a cDNA Encoding a Novel C18-Delta(9) Polyunsaturated Fatty Acid-Specific Elongating Activity from the Docosahexaenoic Acid (DHA)-Producing Microalga, *Isochrysis galbana*.

National Center for Biotechnology Information General Identifier No. 2440162, Accession No. Y14837, Markausakas et al., A New Cloning Vector PUC57, Feb. 11, 1999.

Guhaniyogi et al., Regulation of MRNA Stability in Mammalian Cells, Gene, vol. 183, pp. 626-645, 1990.

Jotun Hein, Unified Approach to Alignment and Phylogenies, Methods in Enzymology, vol. 183, pp. 626-645, 1990.

* cited by examiner

| Sample Name | Fatty Acid | 16:0 | 16:1 (9) | 18:0 | 18:1 (9) | LA | GLA | ALA | STA | EDA | DGLA | ARA | EtrA | ETA | EPA | 22:2 (13, 16) | 22:4 (7, 10, 13, 16) | DPA | 24:1 | % Eo |
|---|---|---|---|---|---|---|---|---|---|---|---|---|---|---|---|---|---|---|---|---|
| pY75 | None | 12.8 | 54.4 | 3.4 | 28.5 | 0.0 | 0.0 | 0.0 | 0.0 | 0.5 | 0.0 | 0.0 | 0.0 | 0.0 | 0.1 | 0.0 | 0.0 | 0.0 | 0.3 | |
| pY119-5 | | 12.5 | 55.2 | 3.5 | 27.3 | 0.0 | 0.0 | 0.0 | 0.0 | 0.6 | 0.0 | 0.0 | 0.0 | 0.0 | 0.0 | 0.0 | 0.0 | 0.0 | 0.7 | |
| pY119-6 | | 13.0 | 53.8 | 3.6 | 28.3 | 0.0 | 0.0 | 0.0 | 0.0 | 0.5 | 0.0 | 0.0 | 0.0 | 0.0 | 0.0 | 0.0 | 0.0 | 0.0 | 0.6 | |
| pY119-8 | | 12.5 | 52.8 | 3.5 | 30.2 | 0.0 | 0.0 | 0.0 | 0.0 | 0.5 | 0.0 | 0.0 | 0.0 | 0.0 | 0.1 | 0.0 | 0.0 | 0.0 | 0.5 | |
| pY75 | LA | 17.4 | 20.5 | 4.6 | 11.1 | 25.3 | 0.0 | 0.0 | 0.0 | 0.6 | 0.0 | 0.0 | 0.0 | 0.0 | 0.0 | 0.0 | 0.0 | 0.0 | 0.5 | 1.2 |
| pY119-5 | | 13.6 | 30.9 | 3.1 | 12.2 | 32.0 | 0.0 | 0.0 | 0.0 | 7.7 | 0.0 | 0.0 | 0.0 | 0.0 | 0.0 | 0.0 | 0.0 | 0.0 | 0.5 | 19.3 |
| pY119-6 | | 15.2 | 26.7 | 4.0 | 13.4 | 30.7 | 0.0 | 0.0 | 0.0 | 8.7 | 0.0 | 0.0 | 0.5 | 0.0 | 0.0 | 0.2 | 0.0 | 0.0 | 0.6 | 22.1 |
| pY119-8 | | 14.0 | 29.1 | 3.9 | 15.2 | 27.1 | 0.0 | 0.0 | 0.0 | 9.1 | 0.0 | 0.0 | 0.5 | 0.0 | 0.0 | 0.2 | 0.0 | 0.0 | 0.4 | 27.2 |
| pY75 | ALA | 11.1 | 6.2 | 4.4 | 4.4 | 0.2 | 0.0 | 72.7 | 0.0 | 0.4 | 0.0 | 0.0 | 0.0 | 0.0 | 0.0 | 0.0 | 0.0 | 0.0 | 0.3 | 0.4 |
| pY119-5 | | 11.7 | 17.0 | 4.9 | 13.3 | 0.1 | 0.0 | 40.9 | 0.0 | 0.3 | 0.0 | 0.0 | 9.2 | 0.0 | 0.0 | 0.0 | 0.0 | 0.0 | 0.4 | 21.4 |
| pY119-6 | | 11.7 | 16.1 | 5.0 | 12.6 | 0.1 | 0.0 | 42.1 | 0.0 | 0.3 | 0.0 | 0.0 | 11.7 | 0.0 | 0.0 | 0.1 | 0.0 | 0.0 | 0.4 | 21.7 |
| pY119-8 | | 11.1 | 17.0 | 4.7 | 13.1 | 0.1 | 0.0 | 41.1 | 0.0 | 0.2 | 0.0 | 0.0 | 12.2 | 0.0 | 0.0 | 0.1 | 0.0 | 0.0 | 0.4 | 22.9 |
| pY75 | GLA | 16.4 | 7.8 | 5.4 | 6.0 | 0.0 | 62.3 | 0.0 | 0.0 | 0.4 | 0.0 | 0.0 | 0.0 | 0.0 | 0.0 | 0.4 | 0.0 | 0.0 | 0.6 | 0.6 |
| pY119-5 | | 16.4 | 10.1 | 5.8 | 8.4 | 0.0 | 57.1 | 0.0 | 0.0 | 0.4 | 0.4 | 0.0 | 0.0 | 0.4 | 0.0 | 0.5 | 0.0 | 0.0 | 0.7 | 0.8 |
| pY119-6 | | 14.6 | 9.8 | 4.7 | 7.0 | 0.0 | 61.9 | 0.0 | 0.0 | 0.3 | 0.5 | 0.0 | 0.0 | 0.4 | 0.0 | 0.6 | 0.0 | 0.0 | 0.5 | 0.7 |
| pY119-8 | | 16.4 | 8.0 | 4.9 | 6.1 | 0.0 | 62.5 | 0.0 | 0.0 | 0.2 | 0.6 | 0.0 | 0.0 | 0.5 | 0.0 | 0.5 | 0.0 | 0.0 | 0.5 | 0.9 |
| pY75 | STA | 11.5 | 5.9 | 4.9 | 5.9 | 0.0 | 0.0 | 0.0 | 70.7 | 0.2 | 0.0 | 0.0 | 0.0 | 0.0 | 0.0 | 0.0 | 0.0 | 0.0 | 0.5 | 0.5 |
| pY119-5 | | 12.5 | 5.4 | 5.0 | 5.0 | 0.0 | 0.0 | 0.0 | 70.5 | 0.3 | 0.0 | 0.0 | 0.2 | 0.0 | 0.0 | 0.0 | 0.0 | 0.0 | 0.7 | 0.7 |
| pY119-6 | | 11.4 | 6.6 | 5.2 | 7.0 | 0.0 | 0.0 | 0.0 | 68.7 | 0.3 | 0.0 | 0.0 | 0.0 | 0.0 | 0.0 | 0.0 | 0.0 | 0.0 | 0.5 | 0.6 |
| pY119-8 | | 11.3 | 5.0 | 3.9 | 4.5 | 0.0 | 0.0 | 0.0 | 74.5 | 0.2 | 0.0 | 0.0 | 0.0 | 0.0 | 0.0 | 0.0 | 0.0 | 0.0 | 0.5 | 0.6 |
| pY75 | ARA | 19.2 | 33.2 | 4.9 | 17.3 | 0.0 | 0.0 | 0.0 | 0.0 | 0.6 | 0.1 | 24.0 | 0.0 | 0.0 | 0.0 | 0.0 | 0.0 | 0.0 | 0.7 | 0.0 |
| pY119-5 | | 18.6 | 34.4 | 4.8 | 19.0 | 0.0 | 0.0 | 0.0 | 0.0 | 0.5 | 0.1 | 21.7 | 0.0 | 0.0 | 0.0 | 0.0 | 0.1 | 0.0 | 0.8 | 0.5 |
| pY119-6 | | 16.9 | 34.4 | 5.5 | 24.4 | 0.0 | 0.1 | 0.0 | 0.0 | 0.3 | 0.1 | 17.6 | 0.0 | 0.0 | 0.0 | 0.0 | 0.1 | 0.0 | 0.6 | 0.6 |
| pY119-8 | | 17.7 | 36.5 | 4.4 | 18.7 | 0.0 | 0.1 | 0.0 | 0.0 | 0.5 | 0.1 | 21.5 | 0.0 | 0.0 | 0.0 | 0.0 | 0.1 | 0.0 | 0.4 | 0.5 |
| pY75 | EPA | 16.7 | 27.7 | 4.7 | 16.4 | 0.0 | 0.0 | 0.0 | 0.0 | 0.4 | 0.0 | 0.1 | 0.0 | 0.0 | 33.1 | 0.0 | 0.0 | 0.0 | 0.4 | 0.0 |
| pY119-5 | | 16.0 | 29.9 | 5.0 | 18.7 | 0.0 | 0.0 | 0.0 | 0.0 | 0.0 | 0.0 | 0.1 | 0.0 | 0.0 | 29.6 | 0.0 | 0.1 | 0.1 | 0.5 | 0.4 |
| pY119-6 | | 17.4 | 27.3 | 6.0 | 20.8 | 0.0 | 0.0 | 0.0 | 0.0 | 0.0 | 0.0 | 0.1 | 0.0 | 0.0 | 27.7 | 0.1 | 0.1 | 0.1 | 0.5 | 0.4 |
| pY119-8 | | 16.5 | 28.8 | 5.9 | 22.1 | 0.0 | 0.0 | 0.0 | 0.0 | 0.0 | 0.0 | 0.1 | 0.0 | 0.0 | 25.9 | 0.0 | 0.1 | 0.5 | 0.6 | 0.4 |

FIG. 14

```
M....N....:....:....:....W....:....:....:....E.L...:....LK..L....G  Consensus #1
         10        20        30        40        50
  1 MEVVNEIVSIGQEVLPKVDYAQLWSDASHCEVLYLSIAFVILKFTLGPLG  SEQ ID NO5.pro
  1 MALANDAGE---------RIWAAVTDPEILIGTFSYLLLKPLLRNSG    SEQ ID NO27.pro ....:....:....YN.L....:..S..SF....A....Y..G....:....:  Consensus #1
         60        70        80        90       100
 51 PKGQSRMKF--VFTNYNLLMSIYSLGSFLSMAYAM---YTIGV----MS  SEQ ID NO5.pro
 39 LVDEKKGAYRTSMIWYNVLLALFSALSFYVTATALGWDYGTGAWLRRQTG  SEQ ID NO27.pro D....F....:....F..T....FY.SK..EY.D...L.L.GK....L  Consensus #1
        110       120       130       140       150
 91 DNCEKAF------DNNVFRITTQLFYLSKFLEYIDSFYLPLMGKPLTWL  SEQ ID NO5.pro
 89 DTPQFLEQCPSPVWDSKLFTWTAKAFYYSKYVEYLDTAWLVLKGKRVSFL  SEQ ID NO27.pro Q.FHH.GAP.D..L....:NE.VWIF....N.EIH.IMY.YY....:....KF  Consensus #1
        160       170       180       190       200
134 QFFHHLGAPMDMWLFYNYRNEAVWIFVLLNGEIHWIMYGYYWTRLIKLKF  SEQ ID NO5.pro
139 QAFHHFGAPWDVYLGIRLHNEGVWIFMFFNSFIHTIMYTYYGLTAAGYKF  SEQ ID NO27.pro ...K.LIT.MQI.QF..GF..VW.Y.N.PC....D....E.W.FNY.YVG.  Consensus #1
        210       220       230       240       250
184 PMPKSLITSMQIIQFNVGFYIVWKYRNIPCYRQDGMRMFGWFFNYFYVGT  SEQ ID NO5.pro
189 -KAKPLITAMQICQFVGGFLLVWDYINVPCFNSDKGKLFSWAFNYAYVGS  SEQ ID NO27.pro V..LF..F..Q....:.K....A.K..  Consensus #1
        260       270
234 VLCLFLNFYVQTYIVRKHKG-AKKIQ         SEQ ID NO5.pro
238 VFLLECHFFYQDNLATKKSAKAGKQL         SEQ ID NO27.pro
```

| Event | Fatty acid composition (wt.%) | | | | | | | | delta-9 %Elong | LA %Elong | ALA %Elong | Ratio (LA/ALA) %Elong |
|---|---|---|---|---|---|---|---|---|---|---|---|---|
| | 16:0 | 18:0 | 18:1 | LA | ALA | EDA | ERA | | | | | |
| '1936-5-2-1 | 18.4 | 2.4 | 17.5 | 21.7 | 4.7 | 28.6 | 6.6 | | 57.2 | 56.9 | 58.5 | 1.0 |
| '1936-5-2-2 | 15.2 | 2.1 | 14.3 | 24.6 | 7.0 | 29.1 | 7.6 | | 53.8 | 54.2 | 52.2 | 1.0 |
| '1936-5-2-3 | 14.3 | 2.7 | 11.2 | 18.8 | 3.1 | 40.5 | 9.5 | | 69.5 | 68.3 | 75.3 | 0.9 |
| '1936-5-2-4 | 16.5 | 2.5 | 5.2 | 50.3 | 24.1 | 0.9 | 0.5 | | 1.8 | 1.8 | 2.0 | 0.9 |
| '1936-5-2-5 | 14.7 | 2.8 | 10.5 | 20.5 | 4.1 | 38.9 | 8.5 | | 65.7 | 65.4 | 67.2 | 1.0 |
| Average | 15.8 | 2.5 | 11.7 | 27.2 | 8.6 | 27.6 | 6.5 | | 49.6 | 49.3 | 51.0 | |
| '1936-5-3-1 | 13.3 | 2.7 | 26.1 | 23.8 | 4.9 | 23.9 | 5.4 | | 50.5 | 50.2 | 52.4 | 1.0 |
| '1936-5-3-2 | 17.1 | 2.1 | 21.5 | 26.1 | 6.4 | 20.6 | 6.3 | | 45.4 | 44.2 | 49.7 | 0.9 |
| '1936-5-3-3 | 15.3 | 2.2 | 11.0 | 28.5 | 6.1 | 30.4 | 6.4 | | 51.6 | 51.6 | 51.4 | 1.0 |
| '1936-5-3-4 | 13.2 | 3.0 | 19.2 | 17.7 | 3.6 | 35.7 | 7.7 | | 67.1 | 66.8 | 68.2 | 1.0 |
| '1936-5-3-5 | 14.0 | 2.8 | 10.4 | 18.5 | 4.2 | 39.2 | 10.9 | | 68.9 | 67.9 | 72.3 | 0.9 |
| Average | 14.6 | 2.6 | 17.6 | 22.9 | 5.0 | 30.0 | 7.3 | | 56.7 | 56.2 | 58.8 | 1.0 |
| '1936-6-4-1 | 15.1 | 1.6 | 14.7 | 35.4 | 7.5 | 19.8 | 5.8 | | 37.3 | 35.8 | 43.7 | 0.8 |
| '1936-6-4-2 | 12.8 | 2.3 | 21.3 | 16.6 | 2.1 | 38.1 | 6.6 | | 70.5 | 69.7 | 75.6 | 0.9 |
| '1936-6-4-3 | 17.7 | 3.0 | 13.2 | 19.8 | 2.8 | 36.9 | 6.7 | | 65.9 | 65.2 | 70.4 | 0.9 |
| '1936-6-4-4 | 18.5 | 3.1 | 17.1 | 19.9 | 2.4 | 32.8 | 6.2 | | 63.6 | 62.2 | 72.0 | 0.9 |
| '1936-6-4-5 | 16.1 | 2.0 | 17.4 | 25.2 | 4.8 | 28.5 | 6.1 | | 53.5 | 53.0 | 56.2 | 0.9 |
| Average | 16.0 | 2.4 | 16.8 | 23.4 | 3.9 | 31.2 | 6.3 | | 58.2 | 57.2 | 63.6 | 0.9 |
| '1936-6-16-1 | 15.0 | 1.6 | 13.8 | 27.3 | 4.1 | 30.7 | 7.6 | | 54.9 | 52.9 | 64.7 | 0.8 |
| '1936-6-16-2 | 14.6 | 2.2 | 12.0 | 23.2 | 3.0 | 37.2 | 7.8 | | 63.2 | 61.6 | 72.6 | 0.9 |
| '1936-6-16-3 | 16.9 | 2.3 | 12.1 | 19.9 | 2.5 | 39.0 | 7.3 | | 67.4 | 66.2 | 74.6 | 0.9 |
| '1936-6-16-4 | 15.9 | 1.7 | 13.7 | 27.7 | 4.3 | 29.8 | 6.9 | | 53.5 | 51.9 | 61.9 | 0.8 |
| '1936-6-16-5 | 14.5 | 1.5 | 15.1 | 32.0 | 6.0 | 23.5 | 7.4 | | 44.9 | 42.4 | 55.5 | 0.8 |
| Average | 15.4 | 1.8 | 13.3 | 26.0 | 4.0 | 32.1 | 7.4 | | 56.8 | 55.0 | 65.8 | 0.8 |
| '1936-6-26-1 | 14.4 | 3.4 | 22.3 | 16.3 | 2.2 | 37.0 | 4.4 | | 69.1 | 69.4 | 66.8 | 1.0 |
| '1936-6-26-2 | 14.5 | 2.9 | 14.4 | 18.3 | 3.6 | 38.4 | 8.0 | | 68.0 | 67.7 | 69.1 | 1.0 |
| '1936-6-26-3 | 19.4 | 3.1 | 5.5 | 14.9 | 2.6 | 44.0 | 10.5 | | 75.7 | 74.7 | 80.0 | 0.9 |
| '1936-6-26-4 | 18.6 | 2.7 | 7.8 | 21.4 | 4.3 | 38.0 | 7.2 | | 63.7 | 63.9 | 62.8 | 1.0 |
| '1936-6-26-5 | 13.2 | 3.5 | 38.9 | 14.9 | 2.8 | 23.2 | 3.6 | | 60.3 | 60.9 | 56.6 | 1.1 |
| Average | 16.0 | 3.1 | 17.8 | 17.2 | 3.1 | 36.1 | 6.7 | | 67.4 | 67.3 | 67.1 | 1.0 |

FIG. 21

| Event | Fatty acid composition (wt%) | | | | | | | | | | Total delta-9 %Elong | LA %Elong | ALA %Elong | Ratio (LA/ALA) %Elong |
|---|---|---|---|---|---|---|---|---|---|---|---|---|---|---|
| | 16:0 | 18:0 | 18:1 | LA | ALA | EDA | HGLA | ERA | ETA | | | | | |
| 1919-2-2-41 | 16.8 | 3.4 | 10.7 | 17.8 | 1.6 | 19.4 | 26.3 | 0.8 | 3.3 | 72.0 | 72.0 | 72.4 | 1.0 |
| 1919-2-2-42 | 14.7 | 2.4 | 13.8 | 24.3 | 2.6 | 18.7 | 18.9 | 1.3 | 3.2 | 61.0 | 60.8 | 63.2 | 1.0 |
| 1919-2-2-43 | 16.4 | 3.3 | 15.4 | 21.2 | 2.7 | 18.6 | 18.3 | 1.3 | 2.7 | 63.2 | 63.6 | 59.8 | 1.1 |
| 1919-2-2-44 | 15.4 | 2.8 | 16.4 | 22.7 | 3.4 | 18.5 | 16.0 | 1.6 | 3.2 | 60.1 | 60.3 | 58.8 | 1.0 |
| 1919-2-2-45 | 17.0 | 3.6 | 18.8 | 23.6 | 4.6 | 12.3 | 16.4 | 0.8 | 3.1 | 53.6 | 54.8 | 46.2 | 1.2 |
| 1919-2-2-46 | 17.4 | 2.3 | 14.5 | 27.7 | 4.4 | 13.6 | 15.5 | 1.5 | 3.1 | 51.2 | 51.3 | 50.5 | 1.0 |
| Average | 16.3 | 3.0 | 14.9 | 22.9 | 3.2 | 16.9 | 18.6 | 1.2 | 3.1 | 60.2 | 60.5 | 58.5 | 1.0 |
| 1919-4-7-41 | 20.5 | 2.5 | 16.7 | 21.3 | 4.8 | 19.1 | 9.8 | 2.6 | 2.7 | 56.8 | 57.6 | 52.8 | 1.1 |
| 1919-4-7-42 | 23.7 | 3.6 | 10.7 | 18.7 | 3.6 | 26.3 | 5.1 | 6.1 | 2.1 | 64.0 | 62.6 | 69.5 | 0.9 |
| 1919-4-7-43 | 18.7 | 3.0 | 14.4 | 17.6 | 2.8 | 34.9 | 1.8 | 6.1 | 0.7 | 68.1 | 67.6 | 71.0 | 1.0 |
| 1919-4-7-44 | 14.6 | 3.8 | 14.0 | 22.7 | 4.0 | 29.7 | 4.4 | 5.3 | 1.5 | 60.4 | 60.0 | 62.7 | 1.0 |
| 1919-4-7-45 | 19.1 | 2.7 | 10.5 | 20.0 | 4.6 | 19.7 | 15.0 | 4.5 | 3.9 | 63.6 | 63.4 | 64.5 | 1.0 |
| 1919-4-7-46 | 15.3 | 4.4 | 13.0 | 13.6 | 1.6 | 40.5 | 4.9 | 5.1 | 1.8 | 77.4 | 77.0 | 80.6 | 1.0 |
| Average | 18.7 | 3.3 | 13.2 | 19.0 | 3.6 | 28.4 | 6.8 | 5.0 | 2.1 | 65.1 | 64.7 | 66.9 | 1.0 |
| 1919-4-9-41 | 15.4 | 3.0 | 20.9 | 19.2 | 3.0 | 15.5 | 18.7 | 1.0 | 3.3 | 63.5 | 64.0 | 59.6 | 1.1 |
| 1919-4-9-42 | 19.2 | 3.7 | 11.3 | 15.0 | 4.0 | 14.5 | 26.7 | 1.1 | 4.5 | 71.2 | 73.3 | 58.5 | 1.3 |
| 1919-4-9-43 | 12.9 | 4.2 | 25.7 | 21.1 | 2.7 | 14.9 | 14.4 | 1.0 | 3.1 | 58.3 | 58.1 | 60.0 | 1.0 |
| 1919-4-9-44 | 14.7 | 2.6 | 13.8 | 24.0 | 2.4 | 15.7 | 21.9 | 1.2 | 3.8 | 61.7 | 61.0 | 67.4 | 0.9 |
| 1919-4-9-45 | 17.2 | 2.5 | 13.4 | 24.9 | 4.8 | 8.7 | 22.9 | 0.7 | 4.8 | 55.5 | 55.9 | 53.5 | 1.0 |
| 1919-4-9-46 | 17.6 | 2.0 | 14.4 | 21.6 | 2.8 | 13.0 | 23.1 | 1.2 | 4.3 | 63.0 | 62.6 | 66.0 | 0.9 |
| Average | 16.2 | 3.0 | 16.6 | 21.0 | 3.3 | 13.7 | 21.3 | 1.0 | 4.0 | 62.2 | 62.5 | 60.8 | 1.0 |
| 1919-5-5-41 | 20.9 | 2.1 | 14.1 | 18.2 | 2.8 | 15.9 | 19.9 | 2.3 | 4.0 | 66.7 | 66.3 | 69.2 | 1.0 |
| 1919-5-5-42 | 17.4 | 2.6 | 18.0 | 21.3 | 4.5 | 10.0 | 19.8 | 1.6 | 4.9 | 58.4 | 58.3 | 59.1 | 1.0 |
| 1919-5-5-43 | 20.8 | 1.5 | 8.0 | 23.0 | 5.7 | 8.6 | 25.9 | 1.2 | 5.2 | 58.8 | 60.0 | 53.1 | 1.1 |
| 1919-5-5-44 | 23.6 | 4.5 | 9.6 | 9.9 | 0.9 | 22.4 | 23.0 | 2.0 | 4.1 | 82.7 | 82.1 | 87.2 | 0.9 |
| 1919-5-5-45 | 17.3 | 1.8 | 21.0 | 26.1 | 8.3 | 4.1 | 16.0 | 0.8 | 4.6 | 42.5 | 43.4 | 39.7 | 1.1 |
| 1919-5-5-46 | 20.8 | 3.0 | 13.4 | 19.6 | 3.6 | 15.5 | 19.6 | 1.5 | 3.0 | 63.1 | 64.2 | 55.7 | 1.2 |
| Average | 20.1 | 2.6 | 14.0 | 19.7 | 4.3 | 12.8 | 20.7 | 1.6 | 4.3 | 62.0 | 62.4 | 60.7 | 1.0 |
| 1919-6-8-41 | 18.3 | 1.9 | 10.4 | 18.5 | 2.9 | 13.9 | 27.6 | 1.6 | 4.9 | 69.1 | 69.1 | 69.2 | 1.0 |
| 1919-6-8-42 | 19.2 | 2.3 | 13.7 | 17.3 | 2.3 | 29.7 | 7.6 | 5.4 | 2.6 | 69.8 | 68.3 | 77.7 | 0.9 |
| 1919-6-8-43 | 14.7 | 2.5 | 29.6 | 28.0 | 7.5 | 8.0 | 5.2 | 2.0 | 2.5 | 33.3 | 32.0 | 37.5 | 0.9 |
| 1919-6-8-44 | 17.8 | 2.5 | 17.7 | 10.5 | 1.4 | 25.5 | 17.5 | 3.5 | 3.6 | 80.8 | 80.4 | 83.8 | 1.0 |
| 1919-6-8-45 | 17.8 | 2.3 | 14.8 | 15.9 | 2.5 | 29.2 | 9.6 | 5.2 | 2.7 | 71.8 | 71.0 | 75.9 | 0.9 |
| 1919-6-8-46 | 15.6 | 2.5 | 15.0 | 17.9 | 3.4 | 15.4 | 21.8 | 2.4 | 6.1 | 68.3 | 67.6 | 71.7 | 0.9 |
| Average | 17.2 | 2.3 | 16.9 | 18.0 | 3.3 | 20.3 | 14.9 | 3.3 | 3.7 | 65.5 | 64.7 | 69.3 | 0.9 |

FIG. 22

| Event | Fatty acid composition (wt.%) | | | | | | | | |
|---|---|---|---|---|---|---|---|---|---|
| | 16:0 | 18:0 | 18:1 | LA | ALA | 20:0 | 20:1(11) | EDA | ERA |
| wild-type (wt) | 8.4 | 2.9 | 14.6 | 30.6 | 20.3 | 1.8 | 18.7 | 2.2 | 0.5 |
| wt pKR926-1 | 8.0 | 3.0 | 13.6 | 26.2 | 11.0 | 1.4 | 15.5 | 14.6 | 6.6 |
| wt pKR926-2 | 8.1 | 3.3 | 13.5 | 26.0 | 12.4 | 1.6 | 17.1 | 12.3 | 5.7 |
| wt pKR926-3 | 8.6 | 3.0 | 13.7 | 28.1 | 11.2 | 1.5 | 16.3 | 12.4 | 5.2 |
| wt pKR926-4 | 8.3 | 3.0 | 15.1 | 29.0 | 12.5 | 1.5 | 17.8 | 9.2 | 3.6 |
| wt pKR926-5 | 8.2 | 3.1 | 13.7 | 26.5 | 11.5 | 1.5 | 16.0 | 13.4 | 6.0 |
| wt pKR926-6 | 8.4 | 3.2 | 14.0 | 27.2 | 11.3 | 1.5 | 16.4 | 12.7 | 5.4 |
| wt pKR926-7 | 8.3 | 3.1 | 13.8 | 27.0 | 11.2 | 1.5 | 16.3 | 13.2 | 5.5 |
| wt pKR926-8 | 8.9 | 2.9 | 12.4 | 26.5 | 11.8 | 1.4 | 14.7 | 14.7 | 6.7 |
| wt pKR926-9 | 8.1 | 3.2 | 13.5 | 26.1 | 11.9 | 1.5 | 16.2 | 13.3 | 6.1 |
| wt pKR926-10 | 8.4 | 3.2 | 14.3 | 27.7 | 12.0 | 1.5 | 16.6 | 11.4 | 4.9 |
| wt pKR926-11 | 8.8 | 3.1 | 13.3 | 26.3 | 10.8 | 1.5 | 15.1 | 14.7 | 6.3 |
| wt pKR926-12 | 8.3 | 3.1 | 12.8 | 26.8 | 10.8 | 1.4 | 15.7 | 14.7 | 6.3 |
| wt pKR926-13 | 8.9 | 3.0 | 15.3 | 32.6 | 15.6 | 1.7 | 19.4 | 2.8 | 0.8 |
| wt pKR926-14 | 8.1 | 3.0 | 13.8 | 27.4 | 12.1 | 1.6 | 17.6 | 11.5 | 4.9 |
| wt pKR926-15 | 8.3 | 2.7 | 12.7 | 27.6 | 12.5 | 1.4 | 16.1 | 13.0 | 5.8 |
| wt pKR926-16 | 8.3 | 3.0 | 13.8 | 27.7 | 12.9 | 1.6 | 17.7 | 10.4 | 4.6 |
| wt pKR926-17 | 8.0 | 3.1 | 14.5 | 28.3 | 12.8 | 1.6 | 17.6 | 9.9 | 4.2 |
| wt pKR926-18 | 8.4 | 3.1 | 14.2 | 26.7 | 12.3 | 1.5 | 16.5 | 12.0 | 5.3 |
| wt pKR926-19 | 7.7 | 3.1 | 14.3 | 27.0 | 12.6 | 1.7 | 17.9 | 10.9 | 4.9 |
| wt pKR926-20 | 8.4 | 3.0 | 14.0 | 27.3 | 11.9 | 1.4 | 16.4 | 12.2 | 5.2 |
| wt pKR926-21 | 8.4 | 3.1 | 12.8 | 24.8 | 10.0 | 1.4 | 14.8 | 16.9 | 7.7 |
| wt pKR926-22 | 8.0 | 3.0 | 13.8 | 26.6 | 11.0 | 1.5 | 16.1 | 14.0 | 6.0 |

FIG. 23

Fatty acid composition (wt.%)

| Event | 16:0 | 18:0 | 18:1 | LA | ALA | 20:0 | 20:1(11) | EDA | ERA |
|---|---|---|---|---|---|---|---|---|---|
| fad3/fae1 (ff) | 8.8 | 3.0 | 29.7 | 56.2 | 1.1 | 0.7 | 0.3 | 0.2 | 0.0 |
| ff pKR926-1 | 8.7 | 3.0 | 22.8 | 42.2 | 0.8 | 0.8 | 1.8 | 19.1 | 0.8 |
| ff pKR926-2 | 9.9 | 3.0 | 28.6 | 55.6 | 1.6 | 0.7 | 0.4 | 0.2 | 0.0 |
| ff pKR926-3 | 9.2 | 3.1 | 22.4 | 45.3 | 1.4 | 0.7 | 0.8 | 16.2 | 0.7 |
| ff pKR926-4 | 8.2 | 2.9 | 27.4 | 48.9 | 2.3 | 0.8 | 2.0 | 7.2 | 0.3 |
| ff pKR926-5 | 10.2 | 3.0 | 20.9 | 45.6 | 2.0 | 0.8 | 0.7 | 15.8 | 0.9 |
| ff pKR926-6 | 8.8 | 2.9 | 22.3 | 46.2 | 1.6 | 0.7 | 1.1 | 15.7 | 0.6 |
| ff pKR926-7 | 8.1 | 2.9 | 25.2 | 42.4 | 0.5 | 0.7 | 1.1 | 18.3 | 0.8 |
| ff pKR926-8 | 9.7 | 3.0 | 23.2 | 45.1 | 1.8 | 0.7 | 0.7 | 15.1 | 0.8 |
| ff pKR926-9 | 8.4 | 3.1 | 23.7 | 40.7 | 0.4 | 0.6 | 1.4 | 20.9 | 0.9 |
| ff pKR926-10 | 9.3 | 3.0 | 25.8 | 47.7 | 1.0 | 0.7 | 0.5 | 11.6 | 0.5 |
| ff pKR926-11 | 9.0 | 3.2 | 26.1 | 45.9 | 1.1 | 0.8 | 0.9 | 12.5 | 0.6 |
| ff pKR926-12 | 8.6 | 3.0 | 28.1 | 43.6 | 1.0 | 0.7 | 0.8 | 13.6 | 0.6 |
| ff pKR926-13 | 8.8 | 3.2 | 26.2 | 45.8 | 0.6 | 0.7 | 0.9 | 13.2 | 0.6 |
| ff pKR926-14 | 8.7 | 2.8 | 23.1 | 42.9 | 1.1 | 0.7 | 1.4 | 18.5 | 0.8 |
| ff pKR926-15 | 8.9 | 3.1 | 21.6 | 41.6 | 0.8 | 0.8 | 1.7 | 20.6 | 0.9 |
| ff pKR926-16 | 8.9 | 3.0 | 24.6 | 44.9 | 1.1 | 0.7 | 0.8 | 15.2 | 0.8 |

| Event | Fatty acid composition (wt %) | | | | | | | | | Total delta-9 %Elong | LA %Elong | ALA %Elong | Ratio (LA/ALA) %Elong |
|---|---|---|---|---|---|---|---|---|---|---|---|---|---|
| | 16:0 | 18:0 | 18:1 | LA | ALA | 20:0 | 20:1(11) | EDA | ERA | | | | |
| wild-type (wt) | 8.4 | 2.9 | 14.6 | 30.6 | 20.3 | 1.8 | 18.7 | 2.2 | 0.5 | 5.0 | 6.7 | 2.5 | 2.7 |
| wt pKR926-8-1 | 10.6 | 2.4 | 12.2 | 26.5 | 8.4 | 0.0 | 10.2 | 21.8 | 7.9 | 46.0 | 45.2 | 48.6 | 0.9 |
| wt pKR926-8-2 | 8.6 | 2.7 | 11.1 | 25.1 | 10.5 | 1.0 | 11.3 | 20.1 | 9.6 | 45.5 | 44.4 | 47.9 | 0.9 |
| wt pKR926-8-3 | 7.2 | 3.0 | 10.6 | 23.1 | 10.0 | 1.5 | 14.3 | 20.2 | 10.1 | 47.8 | 46.7 | 50.4 | 0.9 |
| wt pKR926-8-4 | 7.0 | 2.8 | 10.0 | 21.7 | 9.2 | 1.5 | 13.0 | 22.8 | 11.9 | 52.8 | 51.1 | 56.4 | 0.9 |
| wt pKR926-8-5 | 8.4 | 3.2 | 11.8 | 22.9 | 7.2 | 1.5 | 11.7 | 23.3 | 10.0 | 52.5 | 50.4 | 58.0 | 0.9 |
| wt pKR926-8-6 | 5.8 | 3.2 | 14.8 | 32.2 | 17.1 | 1.9 | 19.5 | 2.3 | 0.4 | 5.0 | 6.6 | 2.1 | 3.2 |
| wt pKR926-8-7 | 7.3 | 2.8 | 16.1 | 29.6 | 18.5 | 1.9 | 21.4 | 2.1 | 0.4 | 5.0 | 6.7 | 2.2 | 3.1 |
| wt pKR926-8-8 | 7.9 | 3.2 | 10.8 | 24.1 | 8.5 | 1.5 | 13.5 | 21.2 | 9.4 | 48.4 | 46.8 | 52.5 | 0.9 |
| wt pKR926-8-9 | 7.9 | 3.2 | 11.4 | 24.4 | 7.9 | 1.4 | 13.3 | 21.5 | 9.0 | 48.6 | 46.9 | 53.3 | 0.9 |
| wt pKR926-8-10 | 8.6 | 3.0 | 10.2 | 21.5 | 9.3 | 1.2 | 10.3 | 23.5 | 12.4 | 53.7 | 52.2 | 56.9 | 0.9 |
| fad3/fae1 (ff) | 6.8 | 3.0 | 29.7 | 56.2 | 1.1 | 0.7 | 0.3 | 0.2 | 0.0 | 0.3 | 0.3 | 0.0 | 0.3 |
| ff pKR926-1-1 | 8.0 | 3.0 | 21.9 | 40.1 | 0.2 | 0.6 | 1.9 | 23.3 | 0.9 | 37.5 | 36.7 | 79.5 | 0.5 |
| ff pKR926-1-2 | 8.3 | 4.1 | 18.8 | 31.1 | 1.1 | 0.7 | 1.6 | 33.1 | 1.3 | 51.7 | 51.6 | 54.1 | 1.0 |
| ff pKR926-1-3 | 7.5 | 3.0 | 23.1 | 40.5 | 0.2 | 0.6 | 1.7 | 22.5 | 0.9 | 36.5 | 35.7 | 81.1 | 0.4 |
| ff pKR926-1-4 | 8.3 | 3.1 | 30.4 | 55.8 | 1.3 | 0.8 | 0.3 | 0.2 | 0.0 | 0.2 | 0.2 | 0.0 | 0.5 |
| ff pKR926-1-5 | 8.2 | 3.1 | 32.1 | 54.5 | 1.0 | 0.6 | 0.3 | 0.1 | 0.0 | 0.3 | 0.3 | 0.0 | 0.4 |
| ff pKR926-1-6 | 7.2 | 2.8 | 24.4 | 38.1 | 0.2 | 0.6 | 1.3 | 24.3 | 1.0 | 39.7 | 38.9 | 81.8 | 0.5 |
| ff pKR926-1-7 | 8.1 | 2.8 | 22.6 | 43.1 | 0.2 | 0.6 | 1.5 | 20.2 | 0.9 | 32.8 | 31.9 | 78.4 | 0.4 |
| ff pKR926-1-8 | 9.6 | 2.8 | 28.2 | 57.3 | 1.2 | 0.6 | 0.3 | 0.0 | 0.0 | 0.0 | 0.0 | 0.0 | 0.4 |
| ff pKR926-1-9 | 9.2 | 2.9 | 21.5 | 41.4 | 0.3 | 0.6 | 1.3 | 21.7 | 1.1 | 35.3 | 34.4 | 77.5 | 0.4 |
| ff pKR926-1-10 | 7.9 | 2.7 | 23.7 | 44.2 | 0.3 | 0.5 | 1.4 | 18.5 | 0.8 | 30.2 | 29.5 | 71.5 | 0.4 |

Fatty Acid Composition (wt.%)

| Event | Embryos Analyzed | 16:0 | 18:0 | 18:1 | LA | GLA | ALA | EDA | HGLA | ARA | ERA | JUN | ETA | EPA | DPA | Other | Total delta-9 %Elong |
|---|---|---|---|---|---|---|---|---|---|---|---|---|---|---|---|---|---|
| AFS 4697-6-1 | 9 | 15.5 | 2.0 | 17.2 | 22.7 | 0.1 | 14.9 | 2.7 | 1.6 | 0.3 | 1.3 | 1.6 | 3.3 | 14.8 | 0.2 | 1.9 | 40.7 |
| AFS 4709-6-15 | 10 | 13.8 | 1.9 | 14.8 | 15.6 | 0.0 | 15.1 | 4.2 | 0.5 | 0.1 | 4.6 | 9.9 | 2.7 | 14.5 | 0.2 | 2.1 | 54.5 |
| AFS 4709-6-8 | 10 | 15.8 | 1.8 | 16.2 | 25.3 | 0.1 | 12.5 | 2.9 | 1.3 | 0.2 | 2.0 | 2.1 | 4.1 | 14.3 | 0.1 | 1.4 | 41.7 |
| AFS 4709-5-7 | 10 | 15.3 | 1.7 | 19.6 | 21.3 | 0.0 | 13.7 | 2.0 | 0.5 | 0.0 | 2.2 | 3.9 | 3.1 | 14.0 | 0.1 | 2.5 | 42.6 |
| AFS 4709-8-6 | 10 | 16.3 | 2.7 | 17.3 | 18.3 | 0.0 | 12.2 | 5.2 | 1.1 | 0.1 | 3.4 | 4.3 | 3.2 | 13.8 | 0.5 | 1.8 | 50.8 |
| AFS 4697-6-5 | 10 | 15.7 | 2.4 | 16.1 | 24.5 | 0.0 | 16.5 | 2.2 | 1.7 | 0.3 | 1.1 | 1.4 | 3.0 | 13.7 | 0.1 | 1.3 | 36.3 |
| AFS 4697-7-5 | 10 | 14.4 | 3.1 | 18.4 | 16.8 | 0.0 | 6.1 | 9.6 | 1.7 | 0.3 | 3.5 | 5.4 | 3.6 | 13.7 | 0.4 | 2.9 | 62.5 |
| AFS 4709-5-5 | 10 | 15.9 | 2.0 | 16.3 | 26.4 | 0.0 | 14.3 | 2.0 | 1.4 | 0.1 | 1.4 | 1.2 | 6.0 | 11.8 | 0.1 | 1.1 | 37.0 |
| AFS 4697-7-3 | 10 | 3.1 | 3.1 | 20.5 | 29.4 | 0.1 | 16.0 | 3.5 | 0.8 | 0.0 | 2.7 | 3.0 | 4.3 | 11.6 | 0.2 | 1.5 | 36.7 |
| AFS 4697-1-5 | 10 | 14.3 | 3.0 | 20.9 | 22.8 | 0.0 | 7.8 | 7.4 | 0.9 | 0.1 | 2.8 | 2.0 | 4.4 | 11.5 | 0.2 | 2.0 | 48.8 |

FIG. 25B

Fatty Acid Composition (wt.%)

| Event | 16:0 | 18:0 | 18:1 | LA | GLA | ALA | EDA | HGLA | ARA | ERA | JUN | ETA | EPA | DPA | Other | Total delta-9 %Elong |
|---|---|---|---|---|---|---|---|---|---|---|---|---|---|---|---|---|
| 4697-6-1-3-2 | 12.8 | 3.9 | 34.4 | 6.7 | 0.0 | 5.5 | 5.6 | 1.0 | 0.1 | 4.8 | 1.6 | 3.8 | 11.0 | 1.5 | 7.2 | 70.6 |
| 4697-6-1-1-7 | 10.6 | 2.9 | 25.4 | 12.1 | 0.0 | 12.6 | 6.3 | 0.3 | 0.2 | 6.4 | 6.9 | 1.1 | 10.2 | 0.3 | 4.7 | 56.2 |
| 4697-6-1-3-4 | 11.2 | 7.3 | 26.0 | 10.6 | 0.0 | 7.8 | 7.9 | 0.8 | 0.2 | 5.3 | 4.4 | 1.7 | 9.1 | 0.3 | 7.4 | 61.8 |
| 4697-6-1-4-4 | 11.8 | 3.9 | 15.3 | 7.8 | 0.0 | 23.7 | 4.6 | 0.3 | 0.2 | 12.7 | 7.8 | 1.3 | 8.6 | 0.1 | 1.8 | 53.0 |
| 4697-6-1-2-10 | 10.4 | 3.1 | 29.0 | 4.9 | 0.0 | 19.7 | 2.7 | 0.2 | 0.0 | 10.3 | 6.5 | 0.9 | 8.0 | 0.1 | 4.1 | 54.0 |
| 4697-6-1-4-9 | 11.2 | 2.8 | 11.7 | 50.8 | 0.0 | 22.6 | 0.1 | 0.0 | 0.0 | 0.0 | 0.0 | 0.0 | 0.0 | 0.1 | 0.5 | 0.0 |
| 4697-6-5-2-4 | 14.4 | 4.8 | 13.3 | 9.4 | 0.0 | 4.9 | 6.1 | 2.6 | 0.0 | 3.7 | 2.9 | 12.2 | 16.2 | 4.3 | 5.3 | 77.1 |
| 4697-6-5-3-4 | 12.8 | 3.4 | 15.5 | 16.1 | 0.0 | 6.3 | 9.3 | 2.0 | 0.2 | 4.5 | 2.1 | 5.4 | 15.1 | 2.7 | 4.5 | 64.9 |
| 4697-6-5-3-1 | 12.0 | 3.7 | 25.3 | 10.0 | 0.1 | 8.6 | 6.6 | 1.4 | 0.2 | 5.5 | 1.7 | 4.9 | 13.9 | 0.8 | 5.2 | 65.3 |
| 4697-6-5-4-4 | 13.5 | 4.8 | 24.3 | 8.5 | 0.0 | 6.8 | 7.3 | 1.3 | 0.0 | 5.3 | 2.7 | 4.7 | 13.9 | 1.1 | 5.8 | 70.3 |
| 4697-6-5-4-2 | 12.5 | 2.9 | 26.7 | 9.1 | 0.0 | 15.3 | 4.5 | 0.6 | 0.3 | 5.6 | 4.7 | 1.5 | 13.1 | 0.0 | 3.2 | 55.5 |
| 4697-6-5-4-1 | 13.3 | 3.1 | 13.6 | 51.3 | 0.0 | 17.3 | 0.3 | 0.0 | 0.0 | 0.2 | 0.1 | 0.0 | 0.2 | 0.0 | 0.5 | 0.0 |

```
         M...N.................W.......E.L..........LK..L...G    Consensus #1
     1   MEVVNEIVSIGQEVLPKVDYAQLWSDASHCEVLYLSIAFVILKFTLGPLG           SEQ ID NO5 Euglena gracilis D9e.pro
     1   MALANDAG------------ERIWAAVTDPEILIGTFSYLLLKPLLRNSG           SEQ ID NO27 Isochyrsis galbana D9e.pro
                   10        20        30        40        50

...........YN.L......S..SF...A.A..........                 Consensus #1
    51   PKGQSR--MKFVFTNYNLLMSIYSLGSFLSMAYAM-------------             SEQ ID NO5 Euglena gracilis D9e.pro
    39   LVDEKKGAYRTSMIWYNVLLALFSALSFYVTATALGWDYGTGAWLRRQTG           SEQ ID NO27 Isochyrsis galbana D9e.pro
                   60        70        80        90       100

.T..........D.....F...T....FY.SK...EY.D...L.L.GK....L       Consensus #1
    84   YTIGVMSDNCEKAFDNNVFRITTQLFYLSKFLEYIDSFYLPLMGKPLTWL           SEQ ID NO5 Euglena gracilis D9e.pro
    89   DTPQPLEQCPSPVWDSKLFTWTAKAFYYSKYVEYLDTAWLVLKGKRVSFL           SEQ ID NO27 Isochyrsis galbana D9e.pro
                  110       120       130       140       150

Q.FHH.GAP.D..L......NE.VWIF.....N.FIH.IMY.YY........KF      Consensus #1
   134   QFFHHLGAPMDMWLFYNYRNEAVWIFVLLNGFIHWIMYGYYWTRLIKLKF           SEQ ID NO5 Euglena gracilis D9e.pro
   139   QAFHHFGAPWDVYLGIRLHNEGVWIFMEFNSFIHTIMYTYYGLTAAGYKF           SEQ ID NO27 Isochyrsis galbana D9e.pro
                  160       170       180       190       200

...K.LIT.MQI.QF..GF...VW.Y.N.PC....D.....F.W.FNY.YVG.       Consensus #1
   184   PMPKSLITSMQIIQFNVGFYIVWKYRNIPCYRQDGMRMFGWFFNYFYVGT           SEQ ID NO5 Euglena gracilis D9e.pro
   189   KA-KPLITAMQICQFVGGFLLVWDYINVPCFNSDKGKLFSWAFNYAYVGS           SEQ ID NO27 Isochyrsis galbana D9e.pro
                  210       220       230       240       250

V..LF...F...Q.......K........Q.                             Consensus #1
   234   VLCLFLNFYVQTYIVRKHHKGAKKIQ                                   SEQ ID NO5 Euglena gracilis D9e.pro
   238   VFLLFCHFFYQDNLATKKSAKAGKQL                                   SEQ ID NO27 Isochyrsis galbana D9e.pro
                  260       270
```

```
         .........|.........|.........|.........|.........|.........|
                 10        20        30        40        50        60
     M................L..........W........E.L.........LK...L......   Consensus #1

1  M----EVVNEIVSIGQEVLPKVDYAQLWSDASHCEVLYLSIAFVILKFTL--GPLGPKGQ      SEQ ID NO5 Euglena gracilis D9e.pro
  1  MAAVIEVANEFVAITAETLPKVDYQRLWRDIYSCELLYFSIAFVILKFTL--GELSDSGK      SEQ ID NO127 Eutreptiella D9e.pro
  1  MA--------LANDAGERIWAAVTDPEILIGTFSYLLLKPLLRNSGLVDEKK             SEQ ID NO27 Isochyrsis galbana D9e.pro .........|.........|.........|.........|.........|.........|
                 70        80        90       100       110       120
     .....YN......S..SF......A....Y..G.................C.........D.   Consensus #1

55  SRMKFVFTNYNLLMSIYSLGSFLSMAYAM---YTIGVMSD------NCEKA-FDN          SEQ ID NO5 Euglena gracilis D9e.pro
 59  KILRVLFKWYNLFMSVFSLVSFLCMGYAI---YTVGLYSN------ECDRA-FDN          SEQ ID NO127 Eutreptiella D9e.pro
 45  GAYRTSMIWYNVLLALFSALSFYVTATALGWDYGTGAWLRRQTGDTPQPLFQCPSPVWDS     SEQ ID NO27 Isochyrsis galbana D9e.pro .........|.........|.........|.........|.........|.........|
                130       140       150       160       170       180
     .F.......FY.SK...EY.D....L.L..K.....LQ.FHH.GAP.D..L......E...WIF  Consensus #1

100  NVFRITTQLFYLSKFLEYIDSFYLPLMGKPLTWLQFFHKLGAPMDMWLFYNYRNEAVWIF     SEQ ID NO5 Euglena gracilis D9e.pro
104  SLFREATKVFFYYSKFLEYIDSFYLPLMAKPLSFLQFFHHLGAPMDMWLFVQYSGESIWIF    SEQ ID NO127 Eutreptiella D9e.pro
105  KLFTWTAKAFYYSKYVEYLDTAWLVLKGKRVSFLQAFHHFGAPWDVYLGIRLHNEGVWIF     SEQ ID NO27 Isochyrsis galbana D9e.pro .........|.........|.........|.........|.........|.........|
                190       200       210       220       230       240
     ...N.FIH...MY.YY...........F.....K.LIT.MQI.QE...GF..VW.Y...PC...D..  Consensus #1

160  VLLNGFIHWIMYGYYWTRLIKLKFPMPKSLITSMQIIQFNVGFYIVWKYRNIPCYRQDGM     SEQ ID NO5 Euglena gracilis D9e.pro
164  VFLNGFIHFVMYGYYWTRLMKFNFPMPKQLITAMQITQFNVGFYLVWWYKDIPCYRKDPM     SEQ ID NO127 Eutreptiella D9e.pro
165  MFFNSFIHTIMYTYYGLTAAGYKE-KAKPLITAMQICQFVGGFLLVWDYINVPCFNSDKG     SEQ ID NO27 Isochyrsis galbana D9e.pro .........|.........|.........|.........|.........|.........|
                250       260       270       280
     ...W.FNY.YVG.V..LF..F..........K........K..                        Consensus #1

220  RMEGWFFNYEFYVGTVLCLFLNFYVQTYIVRKHHGA-KKIQ                          SEQ ID NO5 Euglena gracilis D9e.pro
224  RMLAWIFNYWYVGTVLLFINFFVKSYVFRKPKTADKKVQ                            SEQ ID NO127 Eutreptiella D9e.pro
224  KLFSWAFNYAYVGSVFLLFCHFFYQDNLATKKSAKAGKQL                           SEQ ID NO27 Isochyrsis galbana D9e.pro
```

DELTA-9-ELONGASES AND THEIR USE IN MAKING POLYUNSATURATED FATTY ACIDS

This application claims the benefit of U.S. Provisional Application No. 60/739,989, filed Nov. 23, 2005, the entire content of which is herein incorporated by reference.

FIELD OF THE INVENTION

This invention pertains to polynucleotide sequences encoding delta-9 elongases and the use of these elongase in making long-chain polyunsaturated fatty acids (PUFAs).

BACKGROUND OF THE INVENTION

Fatty acids (lipids) are water-insoluble organic biomolecules that can be extracted from cells and tissues by nonpolar solvents such as chloroform, ether or benzene. Lipids have several important biological functions, serving as (1) structural components of membranes; (2) storage and transport forms of metabolic fuels; (3) a protective coating on the surface of many organisms; and, (4) cell-surface components concerned in cell recognition, species specificity and tissue immunity. More specifically, polyunsaturated fatty acids (PUFAs) are important components of the plasma membrane of the cell, where they may be found in such forms as phospholipids and also can be found in triglycerides. PUFAs also serve as precursors to other molecules of importance in human beings and animals, including the prostacyclins, leukotrienes and prostaglandins. There are two main families of PUFAs (i.e., the omega-3 fatty acids and the omega-6 fatty acids).

The human body is capable of producing most of the PUFAs which it requires to function. However, eicosapentaenoic acid (EPA; 20:5, delta-5,8,11,14,17) and docosahexaenoic acid (DHA; 22:6, delta-4,7,10,13,16,19) cannot be synthesized efficiently by the human body and thus must be supplied through the diet. Since the human body cannot produce adequate quantities of these PUFAs, they are called essential fatty acids. Because of their important roles in human health and nutrition, EPA and DHA are the subject of much interest as discussed herein.

DHA is a fatty acid of the omega-3 series according to the location of the last double bond in the methyl end. It is synthesized via alternating steps of desaturation and elongation (see FIG. 15). Production of DHA is important because of its beneficial effect on human health. For example, increased intake of DHA has been shown to be beneficial or have a positive effect in inflammatory disorders (e.g., rheumatoid arthritis), Type II diabetes, hypertension, atherosclerosis, depression, myocardial infarction, thrombosis, some cancers and for prevention of the onset of degenerative disorders such as Alzheimer's disease. Currently the major sources of DHA are oils from fish and algae.

EPA and arachidonic acid (AA or ARA; 20:4, delta-5,8,11, 14) are both delta-5 essential fatty acids. EPA belongs to the omega-3 series with five double bonds in the acyl chain, is found in marine food, and is abundant in oily fish from the North Atlantic. Beneficial or positive effects of increased intake of EPA have been shown in patients with coronary heart disease, high blood pressure, inflammatory disorders, lung and kidney diseases, Type II diabetes, obesity, ulcerative colitis, Crohn's disease, anorexia nervosa, burns, osteoarthritis, osteoporosis, attention deficit/hyperactivity disorder and early stages of colorectal cancer (see, for example, the review of McColl, J., *NutraCos.* 2(4):3540 (2003)).

AA belongs to the omega-6 series with four double bonds. The lack of a double bond in the omega-3 position confers on M different properties than those found in EPA. The eicosanoids produced from AA have strong inflammatory and platelet aggregating properties, whereas those derived from EPA have anti-inflammatory and anti-platelet aggregating properties. AA is recognized as the principal omega-6 fatty acid found in the human brain and an important component of breast milk and many infant formulas, based on its role in early neurological and visual development. AA can be obtained from some foods (such as meat, fish, and eggs), but the concentration is low.

Gamma-linolenic acid (GLA; 18:3, delta-6,9,12) is another essential fatty acid found in mammals. GLA is the metabolic intermediate for very long-chain omega-6 fatty acids and for various active molecules. In mammals, formation of long-chain PUFAs is rate-limited by delta-6 desaturation. Many physiological and pathological conditions such as aging, stress, diabetes, eczema, and some infections have been shown to depress the delta-6 desaturation step. In addition, GLA is readily catabolized from the oxidation and rapid cell division associated with certain disorders (e.g., cancer or inflammation).

As described above, research has shown that various omega fatty acids reduce the risk of heart disease, have a positive effect on children's development and on certain mental illnesses, autoimmune diseases and joint complaints. However, although there are many health benefits associated with a diet supplemented with these fatty acids, it is recognized that different PUFAs exert different physiological effects in the body (e.g., most notably, the opposing physiological effects of GLA and AA). Thus, production of oils using recombinant means is expected to have several advantages over production from natural sources. For example, recombinant organisms having preferred characteristics for oil production can be used, since the naturally occurring fatty acid profile of the host can be altered by the introduction of new biosynthetic pathways in the host and/or by the suppression of undesired pathways, thereby resulting in increased levels of production of desired PUFAs (or conjugated forms thereof) and decreased production of undesired PUFAs. Optionally, recombinant organisms can provide PUFAs in particular forms which may have specific uses; or, oil production can be manipulated such that the ratio of omega-3 to omega-6 fatty acids so produced is modified and/or a specific PUFA is produced without significant accumulation of other PUFA downstream or upstream products (e.g., production of oils comprising AA and lacking GLA).

The mechanism of PUFA synthesis frequently occurs via the delta-6 desaturation pathway. For example, long-chain PUFA synthesis in mammals proceeds predominantly by a delta-6 desaturation pathway, in which the first step is the delta-6 desaturation of linoleic acid (LA; 18:2, delta-9,12) and alpha-linolenic acid (ALA; 18:3, delta-9,12,15) to yield gamma-linolenic acid (GLA; 18:3, delta-6,9,12)) and stearidonic acid (STA; 18:4, delta-6,9,12,15), respectively. Further fatty acid elongation and desaturation steps give rise to arachidonic acid (AA or ARA) and eicosapentaenoic acid (EPA). Accordingly, genes encoding delta-6 desaturases, delta-6 elongase components (also identified as $C_{18/20}$ elongases) and delta-5 desaturases have been cloned from a variety of organisms including higher plants, algae, mosses, fungi, nematodes and humans. Humans can synthesize long-chain PUFAs from the essential fatty acids, LA and ALA; however biosynthesis of long-chain PUFAs is somewhat limited (they are regulated by dietary and hormonal changes), and LA and ALA must be obtained from the diet.

Elongases which have been identified in the past differ in terms of the substrates upon which they act. They are present in both animals and plants. Those found in mammals can act upon saturated, monounsaturated and polyunsaturated fatty acids. However, those found in plants are specific for saturated and monounsaturated fatty acids. Thus, there is a need for a PUFA-specific elongase to produce polyunsaturated fatty acids (PUFAs) in plants.

The elongation process in plants involves a four-step process initiated by the crucial step of condensation of malonate and a fatty acid with release of a carbon dioxide molecule. The substrates in fatty acid elongation are CoA-thioesters. The condensation step is mediated by a 3-ketoacyl synthase, which is generally rate limiting to the overall cycle of four reactions and provides some substrate specificity. The product of one elongation cycle regenerates a fatty acid that has been extended by two carbon atoms (Browse et al., *Trends in Biochemical Sciences* 27(9):467-473 (September 2002); Napier, *Trends in Plant Sciences* 7(2): 51-54 (February 2002)).

WO 02/077213 (published Oct. 3, 2002) describes isolated nucleic acid molecules encoding a fatty acid elongase with specificity for linoleic acid or alpha-linolenic acid from *Isochrysis galbana* (i.e., delta-9 elongase).

U.S. Pat. No. 6,403,349 (issued to Mukerji et al. on Jun. 11, 2002) concerns the identification of nucleotide and amino acid sequences of an elongase gene derived from *Mortierella alpina*.

WO 02/26946 (published Apr. 4, 2002) describes isolated nucleic acid molecules encoding FAD4, FAD5, FAD5-2 and FAD6 fatty acid desaturase family members which are expressed in long-chain PUFA-producing organisms, e.g., *Thraustochytrium, Pythium irregulars, Schizichytrium* and *Crypthecodinium*. It is indicated that constructs containing the desaturase genes can be used in any expression system including plants, animals, and microorganisms for the production of cells capable of producing long-chain PUFAs.

WO 98/55625 (published Dec. 19, 1998) describes the production of PUFAs by expression of polyketide-like synthesis genes in plants.

WO 98/46764 (published Oct. 22, 1998) describes compositions and methods for preparing long-chain fatty acids in plants, plant parts and plant cells which utilize nucleic acid sequences and constructs encoding fatty acid desaturases, including delta-5 desaturases, delta-6 desaturases and delta-12 desaturases.

U.S. Pat. No. 6,075,183 (issued to Knutzon et al. on Jun. 13, 2000) describes methods and compositions for synthesis of long-chain PUFAs in plants.

U.S. Pat. No. 6,459,018 (issued to Knutzon et al. on Oct. 1, 2002) describes a method for producing STA in plant seed utilizing a construct comprising a DNA sequence encoding a delta-6-desaturase.

Spychalla et al. (*Proc. Natl. Acad. Sci. USA*, 94:1142-1147 (1997)) describes the isolation and characterization of a cDNA from *Caenorhabditis elegans* that, when expressed in *Arabidopsis*, encodes a fatty acid desaturase which can catalyze the introduction of an omega-3 double bond into a range of 18- and 20-carbon fatty acids.

An alternate pathway for the biosynthesis of AA and EPA operates in some organisms (i.e., the delta-9 elongase/delta-8 desaturase pathway). Whereby LA and ALA are first elongated to eicosadienoic acid (EDA; 20:2, delta-11,14) and eicosatrienoic acid (EtrA; 20:3, delta-11,14,17), respectively, by a delta-9 elongase. Subsequent delta-8 and delta-5 desaturation of these products yields AA and EPA. The delta-8 pathway is present inter alia, in euglenoid species where it is the dominant pathway for formation of 20-carbon PUFAs.

WO 2000/34439 (published Jun. 15, 2000) discloses amino acid and nucleic acid sequences for delta-5 and delta-8 desaturase enzymes. Based on the information presented herein, it is apparent that the delta-8 nucleotide and amino acid sequences of WO 2000/34439 are not correct. However, the correct sequence is set forth in corresponding U.S. Pat. No. 6,825,017 (issued to Browse et al. on Nov. 30, 2004) that describes desaturases, in particular, delta-5 and delta-8 desaturases and their use in synthesizing PUFAs.

Applicants' Assignee's co-pending application having application Ser. No. 11/166,003 filed Jun. 24, 2005 discloses a delta-8 desaturase from *Euglena gracilis*.

Wallis et al. (*Arch. Biochem. and Biophys.* 365(2):307-316 (May 1999)) describes the cloning of a gene that appears to encode a delta-8 desaturase in *Euglena gracilis*. This sequence appears to be the same sequence disclosed in WO 2000/34439.

Qi et al. (*Nat. Biotech.* 22(6):739-45 (2004)) describes the production of long-chain PUFAs using, among other things, a delta-8 desaturase from *Euglena gracilis*; however, the complete sequence of the delta-8 desaturase is not provided.

WO 2004/057001 (published Jul. 8, 2004) discloses amino acid and nucleic acid sequences for a delta-8 desaturase enzyme from *Euglena gracilis*.

An expansive study of PUFAs from natural sources and from chemical synthesis are not sufficient for commercial needs. Therefore, it is of interest to find alternative means to allow production of commercial quantities of PUFAs. Biotechnology offers an attractive route for producing long-chain PUFAs in a safe, cost efficient manner in microorganisms and plants.

With respect to microorganisms, many algae, bacteria, molds and yeast can synthesize oils in the ordinary course of cellular metabolism. Thus, oil production involves cultivating the microorganism in a suitable culture medium to allow for oil synthesis, followed by separation of the microorganism from the fermentation medium and treatment for recovery of the intracellular oil. Attempts have been made to optimize production of fatty acids by fermenta five means involving varying such parameters as microorganisms used, media and conditions that permit oil production. However, these efforts have proved largely unsuccessful in improving yield of oil or the ability to control the characteristics of the oil composition produced.

One class of microorganisms that has not been previously examined as a production platform for PUFAs (prior to work by the Applicants' Assignee), however, are the oleaginous yeasts. These organisms can accumulate oil up to 80% of their dry cell weight. The technology for growing oleaginous yeast with high oil content is well developed (for example, see EP 0 005 277B1; Ratledge, C., *Prog. Ind. Microbiol.* 16:119-206 (1982)), and may offer a cost advantage compared to commercial micro-algae fermentation for production of omega-3 or omega-6 PUFAs. Whole yeast cells may also represent a convenient way of encapsulating omega-3 or omega-6 PUFA-enriched oils for use in functional foods and animal feed supplements.

WO 2004/101757 and WO 2004/101753 (published Nov. 25, 2004) concern the production of PUFAs in oleaginous yeasts and are Applicants' Assignee's copending applications.

WO 2004/071467 (published Aug. 26, 2004) concerns the production of PUFAs in plants, while WO 2004/071178 (published Aug. 26, 2004) concerns annexin promoters and their use in expression of transgenes in plants; both are Applicants' Assignee's copending applications.

Applicants' Assignee's copending applications also include CL2698 (U.S. patent application Ser. No. 11/265,761, filed Nov. 2, 2005), CL3136 (U.S. patent application Ser. No. 11/264,784, filed Nov. 1, 2005) and CL3160 (U.S. patent application Ser. No. 11/264,737, filed Nov. 1, 2005) (methods of making EPA, ARA and DHA, respectively, in *Yarrowia lipolytica*), each claiming benefit of the earlier provisional filing date of CL2698 on Nov. 4, 2004.

SUMMARY OF THE INVENTION

The invention concerns an isolated polynucleotide comprising:
- (a) a nucleotide sequence encoding a polypeptide having delta-9 elongase activity, wherein the polypeptide has at least 70% amino acid identity, based on the Clustal V method of alignment, when compared to an amino acid sequence as set forth in SEQ ID NO:5 or SEQ ID NO:127;
- (b) a nucleotide sequence encoding a polypeptide having delta-9 elongase activity, wherein the nucleotide sequence has at least 70% sequence identity, based on the BLASTN method of alignment, when compared to a nucleotide sequence as set forth in SEQ ID NO:4, SEQ ID NO:90 or SEQ ID NO:126;
- (c) a nucleotide sequence encoding a polypeptide having delta-9 elongase activity, wherein the nucleotide sequence hybridizes with a nucleotide sequence as set forth in SEQ ID NO:4, SEQ ID NO:90 or SEQ ID NO:126 under the following stringent hybridization conditions: 0.1×SSC, 0.1% SDS, 65° C. and washed with 2×SSC, 0.1% SDS followed by 0.1×SSC, 0.1% SDS; or
- (d) a complement of the nucleotide sequence of (a), (b) or (c), wherein the complement and the nucleotide sequence consist of the same number of nucleotides and are 100% complementary.

In a second embodiment, the invention concerns codon optimization, specifically, an isolated nucleic acid molecule which encodes a delta-9 elongase enzyme as set forth in SEQ ID NO:90 wherein at least 106 codons are codon-optimized for expression in *Yarrowia* sp.

In a third embodiment, the invention concerns a recombinant DNA construct comprising any of the polynucleotides of the invention operably linked to at least one regulatory sequence.

In a fourth embodiment, the invention concerns a cell comprising the recombinant DNA construct of the invention. Of interest are cells selected from the group consisting of plants and yeast.

In a fifth embodiment, the invention concerns a method for transforming a cell, comprising transforming a cell with the recombinant construct of the invention and selecting those cells transformed with the recombinant construct of the invention.

In a sixth embodiment, the invention concerns a method for producing a transformed plant comprising transforming a plant cell with a polynucleotide of the invention and regenerating a plant from the transformed plant cell; A preferred plant is soybean.

In an eighth embodiment, the invention concerns a seed comprising the recombinant construct of the invention.

In a ninth embodiment, the invention concerns method for making long-chain polyunsaturated fatty acids in a cell comprising:
- (a) transforming a cell with the recombinant construct of the invention;
- (b) selecting those transformed cells that make long-chain polyunsaturated fatty acids.

In a tenth embodiment, the invention concerns oil obtained from seed comprising the recombinant construct of the invention.

In an eleventh embodiment, the invention concerns a method for making long-chain polyunsaturated fatty acids in a plant cell comprising:
- (a) transforming a cell with the recombinant construct of the invention; and
- (b) selecting those transformed cells that make long-chain polyunsaturated fatty acids.

In a twelfth embodiment, the invention concerns a method for producing at least one polyunsaturated fatty acid in a soybean cell comprising:
- (a) transforming a soybean cell with a first recombinant DNA construct comprising an isolated polynucleotide encoding at least one delta-9 elongate polypeptide, operably linked to at least one regulatory sequence and at least one additional recombinant DNA construct comprising an isolated polynucleotide, operably linked to at least one regulatory sequence, encoding a polypeptide selected from the group consisting of a delta-4 desaturase, a delta-5 desaturase, a delta-6 desaturase, a delta-12 desaturase, a delta-15 desaturase, a delta-17 desaturase, a delta-9 desaturase, a $C_{14/16}$ elongase, a C $C_{16/18}$ elongase, a C $C_{18/20}$ elongase and a $C_{20/22}$ elongase;
- (b) regenerating a soybean plant from the transformed cell of step (a); and
- (c) selecting those seeds obtained from the plants of step (b) having an altered level of polyunsaturated fatty acids when compared to the level in seeds obtained from a nontransformed soybean plant.

In a thirteenth embodiment, the invention concerns an oilseed plant comprising:
- (a) a first recombinant DNA construct comprising an isolated polynucleotide encoding at least one delta-9 elongase polypeptide, operably linked to at least one regulatory sequence; and
- (b) at least one additional recombinant DNA construct comprising an isolated polynucleotide, operably linked to at least one regulatory sequence, encoding a polypeptide selected from the group consisting of a delta-4 desaturase, a delta-5 desaturase, a delta-6 desaturase, a delta-12 desaturase, a delta-15 desaturase, a delta-17 desaturase, a delta-9 desaturase, a $C_{14/16}$ elongase, a C $C_{16/18}$ elongase, a C $C_{18/20}$ elongase and a $C_{20/22}$ elongase.

Also of interest are seeds obtained from such oilseed plants and oil obtained from these seeds.

In a fourteenth embodiment, the invention concerns food or feed which incorporates oil of the invention.

In a fifteenth embodiment, the invention concerns food or feed comprising an ingredient derived from the processing of the seeds of the invention.

In a sixteenth embodiment, the invention concerns an isolated nucleic acid fragment comprising a nucleic acid sequence encoding a delta-9 elongase, excluding SEQ ID NO:27, wherein the amino acid sequence comprising said elongase contains at least one of the following amino acid sequence motifs selected from the group consisting of:

a) Y N X (L or F) X X X X S X X S F; (SEQ ID NO:130)

b) F Y X S K X X (E or D) Y X D (T or S) X X L; (SEQ ID NO:131)

c) L (Q or H) X F H H X G A; (SEQ ID NO:132)

d) M Y X Y Y X X X X X X (K or R or N) F; (SEQ ID NO:133)

e) K X L (I or L or M) T X X Q; (SEQ ID NO:134)

f) W X F N Y X Y; (SEQ ID NO:135)
and g) Y X G X V X X L F; (SEQ ID NO:136)

wherein X can be any amino acid.

In a seventeenth embodiment, the invention concerns an isolated polynucleotide comprising a nucleotide sequence encoding a polypeptide having delta-9 elongase activity, wherein the nucleotide sequence has at least 70% sequence identity, based on the BLASTN method of alignment, when compared to a nucleotide sequence as set forth in SEQ ID NO:4, SEQ ID NO:90 ir SEQ ID NO:126.

In an eighteenth embodiment, the invention concerns progeny plants obtained from obtained from a plant made by the method of the invention or an oilseed plant of the invention.

Biological Deposits

The following plasmids have been deposited with the American Type Culture Collection (ATCC), 10801 University Boulevard, Manassas, Va. 20110-2209, and bear the following designations, Accession Numbers and dates of deposit (Table 1).

TABLE 1

ATCC Deposits

| Plasmid | Accession Number | Date of Deposit |
| --- | --- | --- |
| pKR72 | PTA-6019 | May 28, 2004 |
| pKR275 | PTA-4989 | Jan. 30, 2003 |
| pKR585 | PTA-6279 | Nov. 4, 2004 |
| pKR578 | PTA-6280 | Nov. 4, 2004 |

BRIEF DESCRIPTION OF THE DRAWINGS AND SEQUENCE LISTINGS

The invention can be more fully understood from the following detailed description and the accompanying drawings and Sequence Listing, which form a part of this application.

A Sequence Listing is provided herewith on Compact Disk. The contents of the Compact Disk containing the Sequence Listing are hereby incorporated by reference in compliance with 37 C.F.R. §1.52(e). The Compact Disks are submitted in triplicate and are identical to one another. The disks are labeled "Copy 1—Sequence Listing", "Copy 2—Sequence Listing", and "CRF—Sequence Listing". The disks contain the following files: BB1562 US NA Sequence Listing has the following size: 572,000 bytes which were created Nov. 16, 2006.

The sequence descriptions summarize the Sequences Listing provided herewith. The Sequence Listing contains one letter codes for nucleotide sequence characters and the single and three letter codes for amino acids as defined in the IUPAC-IUB standards described in *Nucleic Acids Research* 13:3021-3030 (1985) and in the *Biochemical Journal* 219(2): 345-373 (1984).

FIG. 14 are the results of functional analysis of the *Euglena gracilis* delta-9 elongase in *Saccharomyces cerevisiae*.

FIG. 16 shows a Clustal V alignment (with default parameters) of SEQ ID NO:5 (amino acid sequence of the delta-9 elongase of the instant invention) and SEQ ID NO:27 (amino acid sequence of the long-chain PUFA elongation enzyme from *Isochrysis galbana* (NCBI Accession No. AAL37626 (GI 17226123)).

FIG. 20 are the results of the fatty acid analysis of transgenic somatic soybean embryos expressing pKR912.

FIG. 21 are the lipid profiles of the somatic soybean embryos expressing the *Euglena gracilis* delta-9 elongase and the *Euglena gracilis* delta-8 desaturase for the top 5 events.

FIG. 22 are the lipid profiles of T2 bulk seed for the 22 wild-type-transformed events as well as for untransformed wild-type.

FIG. 23 are the lipid profiles of T2 bulk seed for the 16 fad3/fae1-transformed events as well as for untransformed fad3/fae1.

FIG. 24 are the lipid profiles for ten single seeds for wild-type pKR926-8 and ff pKR926-1.

FIG. 25A are the average fatty acid profiles for the ten best EPA events (average of nine or ten individual embryos) for pKR916 and pKR873.

FIG. 25B are the fatty acid profiles for the five best EPA seed from two independent events.

Figure 26A:
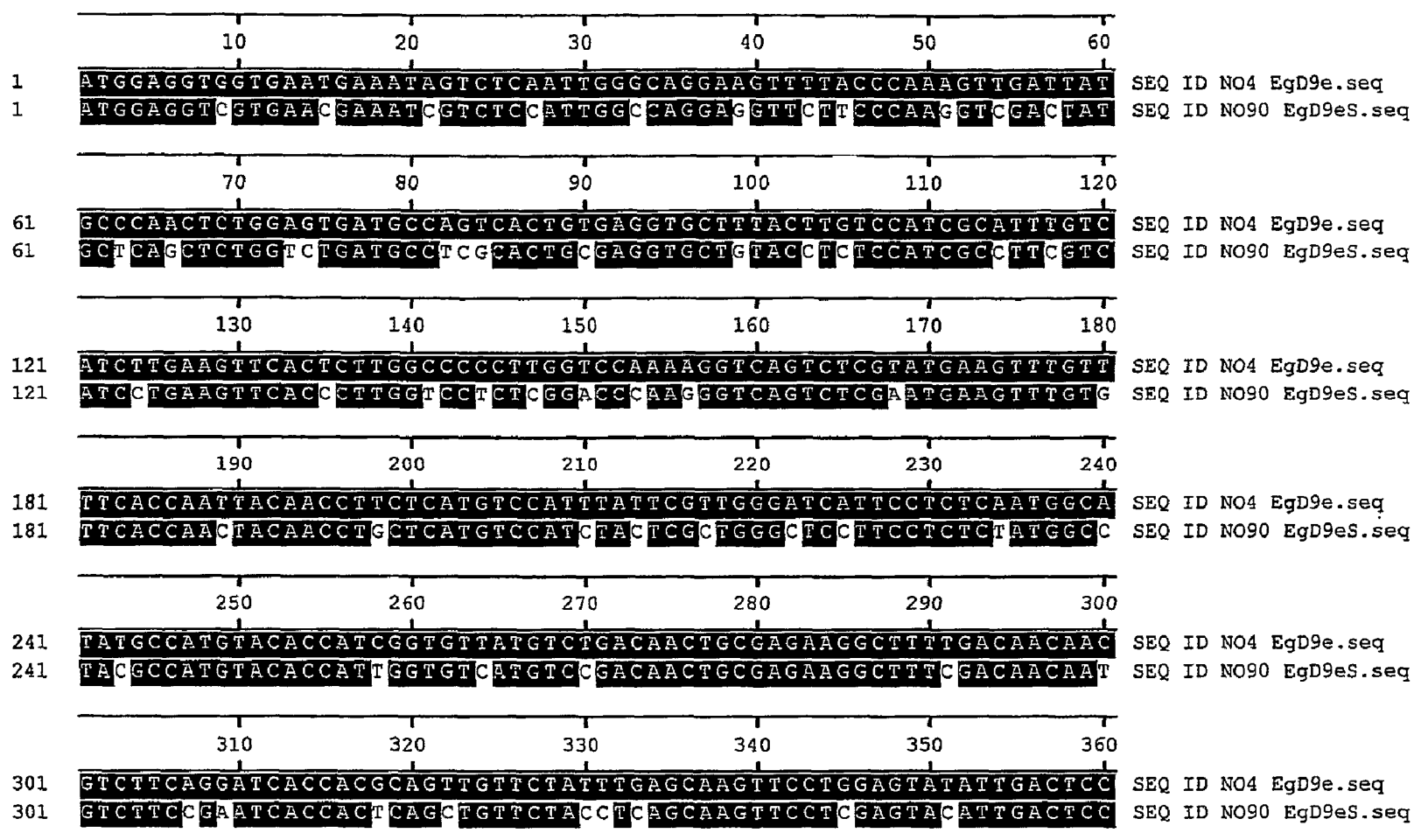
Figure 26B:
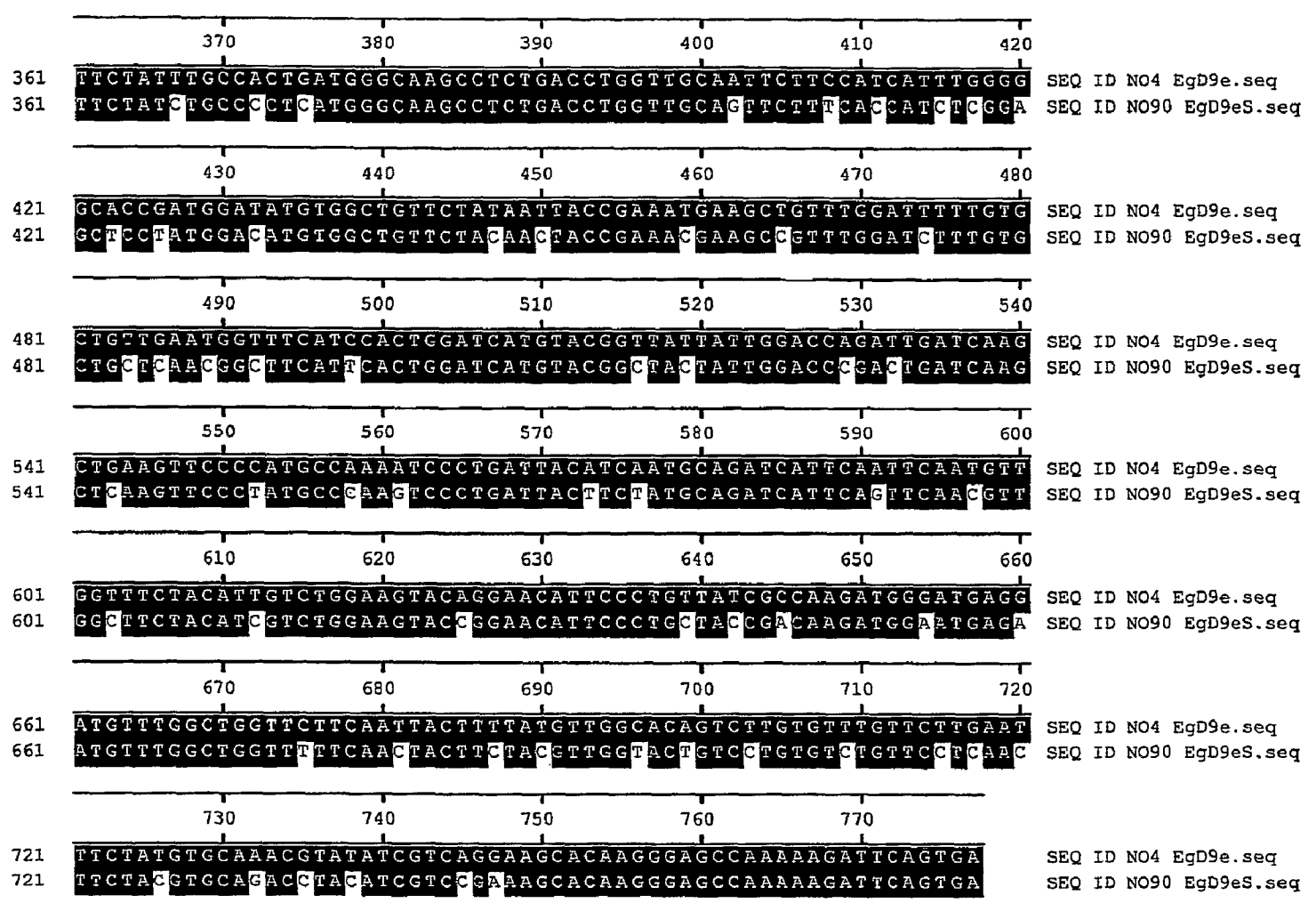

FIGS. 26A and B show a comparison of the nucleotide sequences of *Euglena gracilis* delta-9 elongase (EgD9e) (SEQ ID NO:4) and the synthetic delta-9 elongase, derived from *Euglena gracilis* and codon-optimized for expression in *Yarrowia lipolytica* (EgD9eS) (SEQ ID NO:90).

FIG. 27 show a Clustal W alignment (with default parameters) of SEQ ID NO:5 (amino acid sequence of the delta-9 elongase of the instant invention) and SEQ ID NO:27 (amino acid sequence of the long-chain PUFA elongation enzyme from *Isochrysis galbana* (NCBI Accession No. AAL37626 (GI 17226123)).

Figure 28:
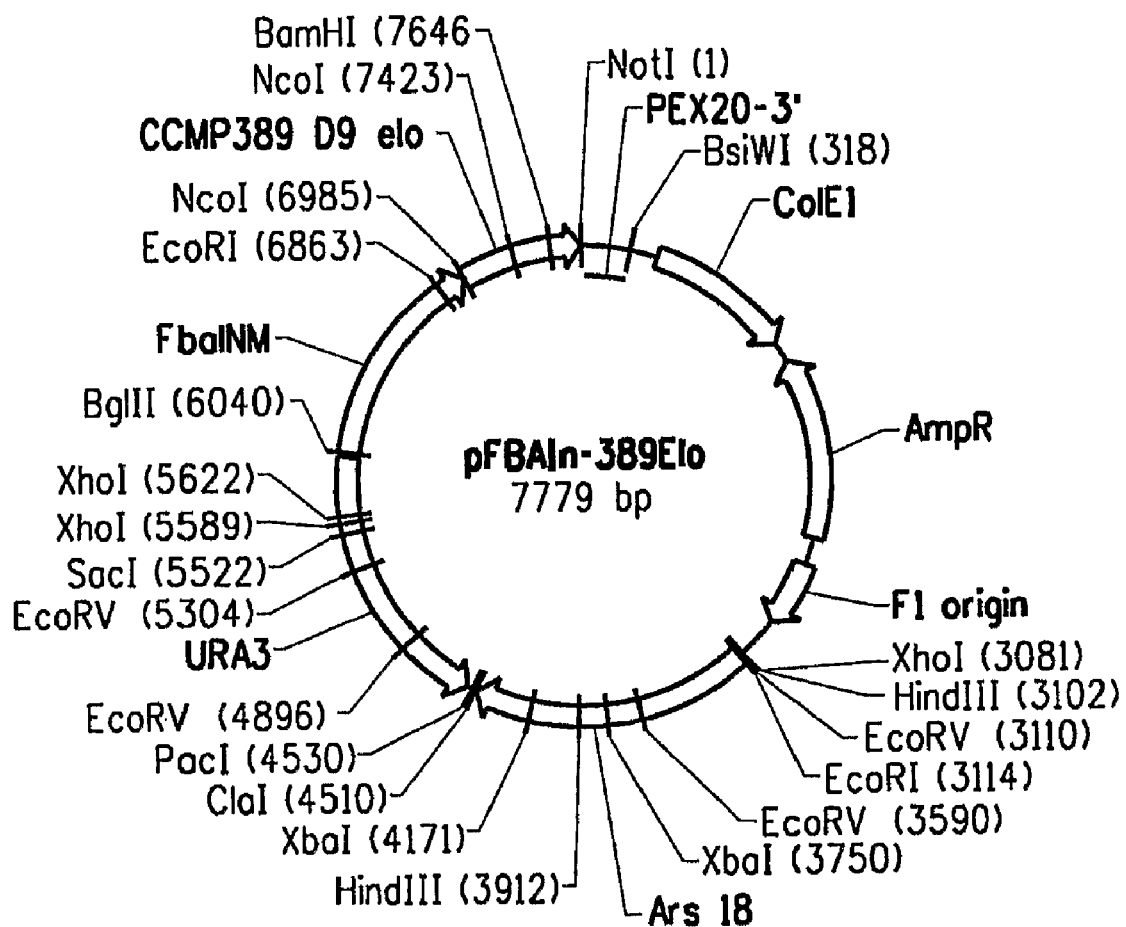

FIG. 28 is a map of plasmid pFBAln-389Elo.

FIG. 29 shows a Clustal V alignment (with default parameters) of the amino acid sequence of the *Euglena gracilis* delta-9 elongase of the instant invention (SEQ ID NO:5), the amino acid sequence of the *Eutreptiella* sp. CCMP389 delta-9 elongase of the instant invention (SEQ ID NO:127) and the amino acid sequence of the long-chain PUFA elongation enzyme from *Isochrysis galbana* (NCBI Accession No. AAL37626 (GI 17226123)) (SEQ ID NO:27).

SEQ ID NO:1 is the 5' sequence of the cDNA insert from clone eeg1c.pk100.n5.f.

SEQ ID NO:2 is the 3' sequence of the cDNA insert from clone eeg1c.pk001.n5.f.

SEQ ID NO:3 is the sequence aligned from SEQ ID NO:1 and SEQ ID NO:2 (full cDNA sequence excluding poly A tail).

SEQ ID NO:4 is nucleotide sequence of the CDS of the *Euglena gracilis* delta-9 elongase of the instant invention (clone eeg1c.pk001.n5.f) (abbreviated EgD9e).

SEQ ID NO:5 is the deduced amino acid sequence of SEQ ID NO:4 (*Euglena gracilis* delta-9 elongase of the instant invention—clone eeg1c.pk001.n5.f).

SEQ ID NO:6 is the sequence of the ig-s primer.
SEQ ID NO:7 is the sequence of the ig-as primer.
SEQ ID NO:8 is the sequence of the oEugEL1-1 primer.
SEQ ID NO:9 is the sequence of the oEugEL1-2 primer.
SEQ ID NO:10 is the sequence of the Eg5-1 primer.
SEQ ID NO:11 is the sequence of the Eg3-3 primer.
SEQ ID NO:12 is the sequence of T7.
SEQ ID NO:13 is the sequence of M13-28Rev.
SEQ ID NO:14 is the sequence of Eg3-2.
SEQ ID NO:15 is the sequence of Eg5-2.
SEQ ID NO:16 is the nucleotide sequence for the *Euglena gracilis* delta-8 desaturase (Eg5).
SEQ ID NO:17 is the amino acid sequence for the *Euglena gracilis* delta-8 desaturase (Eg5) shown in SEQ ID NO:16.
SEQ ID NO:18 is the sequence of the KTi cassette 5' end MCS for pKR457.
SEQ ID NO:19 is the sequence of the KTi cassette 3' end MCS for pKR457 including the soy albumin transcription 3' terminator.
SEQ ID NO:20 is the sequence of the oSalb-12 primer.
SEQ ID NO:21 is the sequence of the oSalb-13 primer.
SEQ ID NO:22 is the sequence of restriction sites added to pKR287 to make pKR767.
SEQ ID NO:23 is the sequence of the oSAlb-9 primer.
SEQ ID NO:24 is the sequence of the oSAlb-2 primer.
SEQ ID NO:25 is the sequence of pZUF17.
SEQ ID NO:26 is the sequence of pDMW237.
SEQ ID NO:27 amino acid sequence of the long-chain PUFA elongation enzyme from *Isochrysis galbana* (NCBI Accession No. AAL37626 (GI 17226123), locus AAL37626, CDS AF390174).
SEQ ID NO:28 is the sequence of the M13F universal primer.
SEQ ID NO:29 is the nucleotide sequence of the long-chain PUFA elongation enzyme from *Isochrysis galbana* (NCBI Accession No. AAL37626 (GI 17226123), locus AAL37626, CDS AF390174) shown in SEQ ID NO:27.
SEQ ID NO:30 is the sequence of pY115 (see FIG. 1).
SEQ ID NO:31 is the sequence of pBY1 (see FIG. 2).
SEQ ID NO:32 is the sequence of pBY2 (see FIG. 3).
SEQ ID NO:33 is the sequence of pBY1-FAE (see FIG. 4).
SEQ ID NO:34 is the sequence of pY120 (see FIG. 5).
SEQ ID NO:35 is the sequence of pY119 (see FIG. 6).
SEQ ID NO:36 is the sequence of pKR72.
SEQ ID NO:37 is the sequence of pKR912 (see FIG. 7).
SEQ ID NO:38 is the sequence of pKS102.
SEQ ID NO:39 is the sequence of pKR197.
SEQ ID NO:40 is the sequence of pKR911 (see FIG. 8).
SEQ ID NO:41 is the sequence of pKS121.
SEQ ID NO:42 is the sequence of pKR457.
SEQ ID NO:43 is the sequence of pKR680.
SEQ ID NO:44 is the sequence of pKR913 (see FIG. 9).
SEQ ID NO:45 is the sequence of pKR767.
SEQ ID NO:46 is the sequence of pKR328.
SEQ ID NO:47 is the sequence of pKR886 (see FIG. 10).
SEQ ID NO:48 is the sequence of pKR886r (see FIG. 10).
SEQ ID NO:49 is the sequence of pKR271.
SEQ ID NO:50 is the sequence of pKR226.
SEQ ID NO:51 is the sequence of pKR275.
SEQ ID NO:52 is the sequence of pKR329.
SEQ ID NO:53 is the sequence of pKR585.
SEQ ID NO:54 is the sequence of pKR578.
SEQ ID NO:55 is the sequence of pKR667.
SEQ ID NO:56 is the sequence of pKR673 (see FIG. 12).
SEQ ID NO:57 is the sequence of pKR832.
SEQ ID NO:58 is the sequence of pKR136.
SEQ ID NO:59 is the sequence of pKR124.
SEQ ID NO:60 is the sequence of pKR163.
SEQ ID NO:61 is the sequence of pY34.
SEQ ID NO:62 is the sequence of pKR863.
SEQ ID NO:63 is the sequence of pKR869.
SEQ ID NO:64 is the sequence of pKR270.
SEQ ID NO:65 is the nucleotide sequence for the synthetic delta-9 elongase derived from *Isochrysis galbana* codon-optimized for expression in *Yarrowia lipolytica*.
SEQ ID NOs:66-81 correspond to primers IL3-1A, IL3-1B, IL3-2A, IL3-2B, IL3-3A, IL3-3B, IL34A, IL3-4B, IL3-5A, IL3-5B, IL3-6A, IL3-6B, IL3-7A, IL3-7B, IL3-8A and IL3-88, respectively, used for amplification as described in Example 4.
SEQ ID NOs:82-85 correspond to primers IL3-1F, IL3-4R, IL3-5F and IL3-8R, respectively, used for amplification as described in Example 4.
SEQ ID NO:86 is the 417 bp NcoI/PstI fragment described in Example 4.
SEQ ID NO:87 is the 377 bp PstI/Not1 fragment described in Example 4.
SEQ ID NO:88 is the sequence of the *Mortierella alpina* delta-5 desaturase.
SEQ ID NO:89 is the sequence of pDMW263.
SEQ ID NO:90 is the nucleotide sequence for the synthetic delta-9 elongase derived from *Euglena gracilis* codon-optimized for expression in *Yarrowia lipolytica*.
SEQ ID NO:91 is the sequence of pKR920 (see FIG. 17).
SEQ ID NO:92 is the sequence of cal a24-4:
SEQ ID NO:93 is the sequence of primer oCal-15.
SEQ ID NO:94 is the sequence of primer oCal-6.
SEQ ID NO:95 is the sequence of pKR53B
SEQ ID NO:96 is the sequence of pKR85.
SEQ ID NO:97 is the sequence of primer oKR85-1.
SEQ ID NO:98 is the sequence of primer oKR85-2.
SEQ ID NO:99 is the sequence of pPCR85.
SEQ ID NO:100 is the sequence of pKR91.
SEQ ID NO:101 is the sequence of pKR92.
SEQ ID NO:102 is the sequence of pKR926 (see FIG. 18)
SEQ ID NO:103 is the sequence of pKR767.
SEQ ID NO:104 is the sequence of pKR916 (see FIG. 19)
SEQ ID NO:105 is the sequence of pZuFmEgD9ES.
SEQ ID NO:106 is the sequence of pZuFmEgD9E.
SEQ ID NO:107 is the sequence of the SMART™ IV oligonucleotide.
SEQ ID NO:108 is the sequence of the CDSIII/3' PCR primer.

SEQ ID NO:109 is the sequence of the 5'-PCR primer.
SEQ ID NO:110 is the sequence of pFBAIN-389Elo.
SEQ ID NO:111 is the sequence of the *Eutreptiella* sp. CCMP389 (E389D9e) complete assembled contig.
SEQ ID NO:112 is the nucleotide sequence of degenerate primer EuEF3.
SEQ ID NO:113 is the deduced amino acid sequence of SEQ ID NO:112.
SEQ ID NO:114 is the nucleotide sequence of degenerate primer EuER3.
SEQ ID NO:115 is the deduced amino acid sequence of SEQ ID NO:114.
SEQ ID NO:116 is the sequence of the 389Elo-5-1 primer.
SEQ ID NO:117 is the sequence of the 389Elo-5-2 primer.
SEQ ID NO:118 is the sequence of the DNR CDS 5'-2 primer.
SEQ ID NO:119 is the sequence of the *Eutreptiella* sp. CCMP389 (E389D9e) 5' cDNA fragment #1.
SEQ ID NO:120 is the sequence of the 389Elo-5-4 primer.
SEQ ID NO:121 is the sequence of the *Eutreptiella* sp. CCMP389 (E389D9e) 5' cDNA fragment #2.
SEQ ID NO:122 is the sequence of the 389Elo-3-1 primer.
SEQ ID NO:123 is the sequence of the 389Elo-3-2 primer.
SEQ ID NO:124 is the sequence of the *Eutreptiella* sp. CCMP389 (E389D9e) 3' cDNA fragment.
SEQ ID NO:125 is the sequence of the *Eutreptiella* sp. CCMP389 (E389D9e) complete assembled contig.
SEQ ID NO:126 is the nucleotide sequence of the *Eutreptiella* sp. CCMP389 (E389D9e) delta-9 elongase.
SEQ ID NO:127 is the deduced amino acid sequence of SEQ ID NO:126 (*Eutreptiella* sp. CCMP389 (E389D9e) delta-9 elongase).
SEQ ID NO:128 is the sequence of pFBAIN-MOD-1.
SEQ ID NO:129 is the sequence of the *Eutreptiella* sp. CCMP389 (E389D9e) internal cDNA fragment.
SEQ ID NOs:130-136 are the motif sequences associated with a delta-9 elongase.

DETAILED DESCRIPTION OF THE INVENTION

All patents, patent applications, and publications cited herein are incorporated by reference in their entirety.

In the context of this disclosure, a number of terms shall be utilized.

The term "fatty acids" refers to long-chain aliphatic acids (alkanoic acids) of varying chain lengths, from about $C_{12}$ to $C_{22}$ (although both longer and shorter chain-length acids are known). The predominant chain lengths are between $C_{16}$ and $C_{22}$. Additional details concerning the differentiation between "saturated fatty acids" versus "unsaturated fatty acids", "monounsaturated fatty acids" versus "polyunsaturated fatty acids" (or "PUFAs"), and "omega-6 fatty acids" (ω-6 or n6) versus "omega-3 fatty acids" (ω-3 or n-3) are provided in WO 2004/101757.

Fatty acids are described herein by a simple notation system of "X:Y", wherein the number before the colon indicates the number of carbon atoms in the fatty acid and the number after the colon is the number of double bonds that are present. The number following the fatty acid designation indicates the position of the double bond from the carboxyl end of the fatty acid with the "c" affix for the cis-configuration of the double bond (e.g., palmitic acid (16:0), stearic acid (18:0), oleic acid (18:1, 9c), petroselinic acid (18:1, 6c), LA (18:2, 9c, 12c), GLA (18:3, 6c, 9c, 12c) and ALA (18:3, 9c, 12c, 15c)). Unless otherwise specified 18:1, 18:2 and 18:3 refer to oleic, LA and linolenic fatty acids. If not specifically written as otherwise, double bonds are assumed to be of the cis configuration. For instance, the double bonds in 18:2 (9,12) would be assumed to be in the cis configuration.

Figure 15:
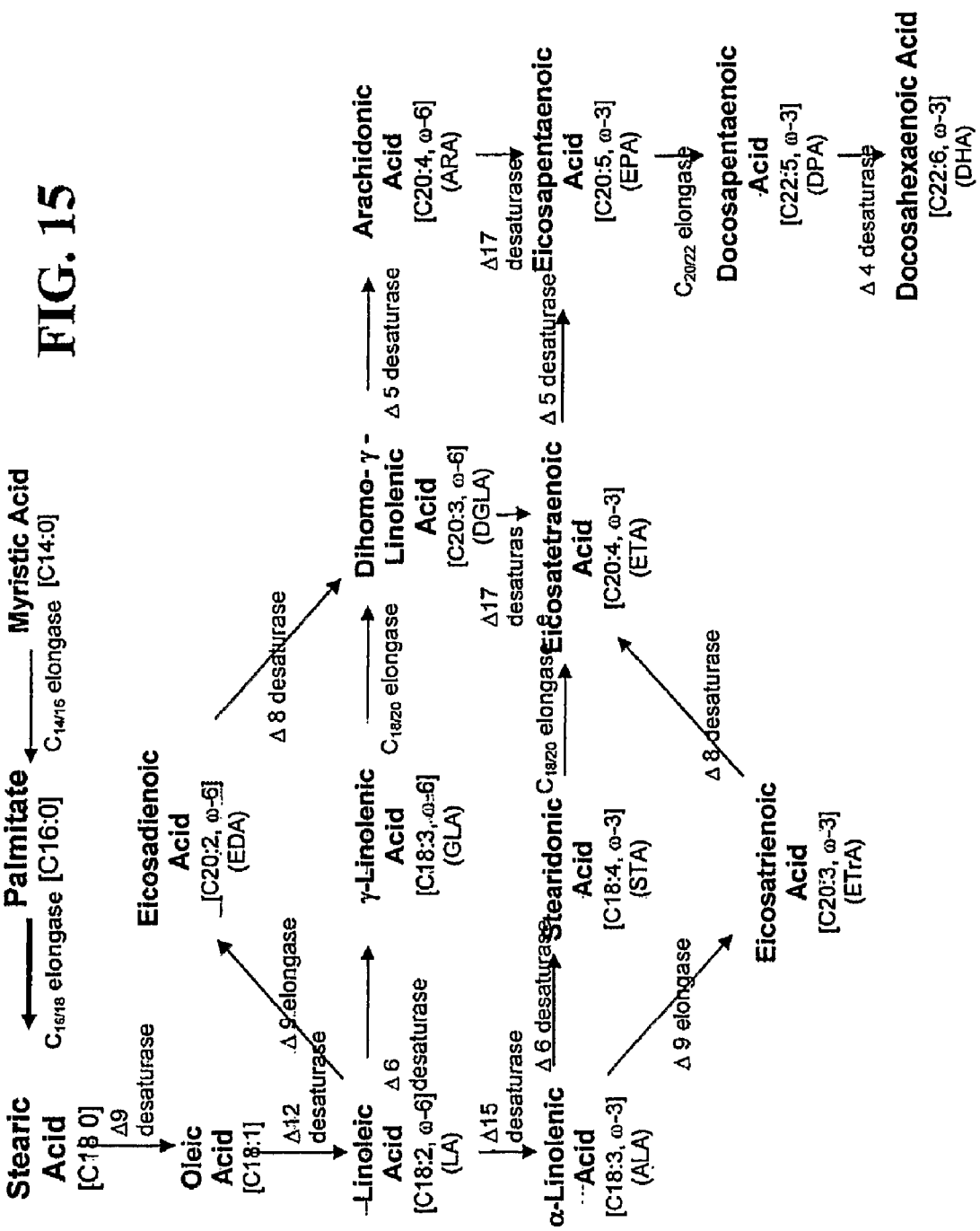
FIG. 15 is a representative omega-3 and omega-6 fatty acid pathway providing for the conversion of myristic acid through various intermediates to docosahexaenoic acid (DHA).

A representative pathway is illustrated in FIG. 15, providing for the conversion of myristic acid through various intermediates to DHA, which demonstrates how both omega-3 and omega-6 fatty acids may be produced from a common source.

Nomenclature used to describe PUFAs in the present disclosure is shown below in Table 2. In the column titled "Shorthand Notation", the omega-reference system is used to indicate the number of carbons, the number of double bonds and the position of the double bond closest to the omega carbon, counting from the omega carbon (which is numbered 1 for this purpose). The remainder of the Table summarizes the common names of omega-3 and omega-6 fatty acids, the abbreviations that will be used throughout the remainder of the specification, and each compounds' chemical name.

TABLE 2

Nomenclature of Polyunsaturated Fatty Acids

| Common Name | Abbreviation | Chemical Name | Shorthand Notation |
|---|---|---|---|
| oleic | — | cis-9-octadecenoic | 18:1 |
| linoleic | LA | cis-9,12-octadecadienoic | 18:2 ω-6 |
| gamma-linolenic | GLA | cis-6,9,12-octadecatrienoic | 18:3 ω-6 |
| eicosadienoic | EDA | cis-11,14-eicosadienoic | 20:2 ω-6 |
| dihomo-gamma-linolenic | DGLA or HGLA | cis-8,11,14-eicosatrienoic | 20:3 ω-6 |
| arachidonic | AA or ARA | cis-5,8,11,14-eicosatetraenoic | 20:4 ω-6 |
| alpha-linolenic | ALA | cis-9,12,15-octadecatrienoic | 18:3 ω-3 |
| stearidonic | STA | cis-6,9,12,15-octadecatetraenoic | 18:4 ω-3 |
| eicosatrienoic | ETrA or ERA | cis-11,14,17-eicosatrienoic | 20:3 ω-3 |
| eicosatetraenoic | ETA | cis-8,11,14,17-eicosatetraenoic | 20:4 ω-3 |
| eicosapentaenoic | EPA | cis-5,8,11,14,17-eicosapentaenoic | 20:5 ω-3 |
| docosapentaenoic | DPA | cis-7,10,13,16,19-docosapentaenoic | 22:5 ω-3 |
| docosahexaenoic | DHA | cis-4,7,10,13,6,19-docosahexaenoic | 22:6 ω-3 |

Other abbreviations that may be used are as follows (the terms and abbreviations may be used interchangeably):
EgD9e=*Euglena gracilis* delta-9 elongase (wild-type)
EgD9eS=synthetic delta-9 elongase, derived from *Euglena gracilis* and codon-optimized for expression in *Yarrowia lipolytica*
E389D9e=*Eutreptiella* sp. CCMP389 delta-9 elongase (wild-type)
E389D9eS=synthetic delta-9 elongase, derived from *Eutreptiella* sp. CCMP389 and codon-optimized for expression in *Yarrowia lipolytica*

The term "essential fatty acid" refers to a particular PUFA that an organism must ingest in order to survive, being unable to synthesize the particular essential fatty acid de novo. For example, mammals can not synthesize the essential fatty acid LA. Other essential fatty acids include, but are not limited to, GLA, DGLA, AA, EPA and DHA.

The term "fat" refers to a lipid substance that is solid at 25° C. and usually saturated.

The term "oil" refers to a lipid substance that is liquid at 25° C. and usually polyunsaturated. PUFAs are found in the oils of some algae, oleaginous yeasts and filamentous fungi.

"Microbial oils" or "single cell oils" are those oils naturally produced by microorganisms during their lifespan. Such oils can contain long-chain PUFAs.

The term "PUFA biosynthetic pathway" refers to a metabolic process that converts oleic acid to LA, EDA, GLA, DGLA, M, ALA, STA, ETrA, ETA, EPA, DPA and DHA. This process is well described in the literature (e.g., see WO 2005/003322 and WO 2006/052870). Simplistically, this process involves elongation of the carbon chain through the addition of carbon atoms and desaturation of the molecule through the addition of double bonds, via a series of special desaturation and elongation enzymes (i.e., "PUFA biosynthetic pathway enzymes") present in the endoplasmic reticulim membrane. More specifically, "PUFA biosynthetic pathway enzymes" refer to any of the following enzymes (and genes which encode said enzymes) associated with the biosynthesis of a PUFA, including: a delta-4 desaturase, a delta-5 desaturase, a delta-6 desaturase, a delta-12 desaturase, a delta-15 desaturase, a delta-17 desaturase, a delta-9 desaturase, a delta-8 desaturase, a delta-9 elongase, a $C_{14/16}$ elongase, a $C_{16/18}$ elongase, a $C_{18/20}$ elongase and/or a $C_{20/22}$ elongase.

"Desaturase" is a polypeptide which can desaturate one or more fatty acids to produce a mono- or poly-unsaturated fatty acid or precursor which is of interest. Of particular interest herein are delta-8 desaturases that will desaturate a fatty acid between the eighth and ninth carbon atom numbered from the carboxyl-terminal end of the molecule and that can, for example, catalyze the conversion of EDA to DGLA and/or ETrA to ETA. Other useful fatty acid desaturases include, for example, (1) delta-5 desaturases that catalyze the conversion of DGLA to AA and/or ETA to EPA; (2) delta-6 desaturases that catalyze the conversion of LA to GLA and/or ALA to STA; (3) delta-4 desaturases that catalyze the conversion of DPA to DHA; (4) delta-12 desaturases that catalyze the conversion of oleic acid to LA; (5) delta-15 desaturases that catalyze the conversion of LA to ALA and/or GLA to STA; (6) delta-17 desaturases that catalyze the conversion of M to EPA and/or DGLA to ETA; and (7) delta-9 desaturases that catalyze the conversion of palmitate to palmitoleic acid (16:1) and/or stearate to oleic acid (18:1).

The term "elongase system" refers to a suite of four enzymes that are responsible for elongation of a fatty acid carbon chain to produce a fatty acid that is two carbons longer than the fatty acid substrate that the elongase system acts upon. More specifically, the process of elongation occurs in association with fatty acid synthase, whereby CoA is the acyl carrier (Lassner et al., *Plant Cell* 8:281-292 (1996)). In the first step, which has been found to be both substrate-specific and also rate-limiting, malonyl-CoA is condensed with a long-chain acyl-CoA to yield carbon dioxide ($CO_2$) and a β-ketoacyl-CoA (where the acyl moiety has been elongated by two carbon atoms). Subsequent reactions include reduction to β-hydroxyacyl-CoA, dehydration to an enoyl-CoA and a second reduction to yield the elongated acyl-CoA. Examples of reactions catalyzed by elongase systems are the conversion of GLA to DGLA, STA to ETA and EPA to DPA.

For the purposes herein, an enzyme catalyzing the first condensation reaction (i.e., conversion of malonyl-CoA to β-ketoacyl-CoA) will be referred to generically as an "elongase". In general, the substrate selectivity of elongases is somewhat broad but segregated by both chain length and the degree of unsaturation. Accordingly, elongases can have different specificities. For example, a $C_{14/16}$ elongase will utilize a $C_{14}$ substrate (e.g., myristic), a $C_{16/18}$ elongase will utilize a $C_{16}$ substrate (e.g., palmitate), a C $C_{18/20}$ elongase will utilize a $C_{18}$ substrate (e.g., GLA, STA) and a $C_{20/22}$ elongase will utilize a $C_{20}$ substrate (e.g., EPA). In like manner, and of particular interest herein, a "delta-9 elongase" is able to catalyze the conversion of LA and ALA to EDA and ETrA. It is important to note that some elongases have broad specificity and thus a single enzyme may be capable of catalyzing several elongase reactions (e.g., thereby acting as both a C $C_{16/18}$ elongase and a $C_{18/20}$ elongase). In preferred embodiments, it is desirable to empirically determine the specificity of a fatty acid elongase by transforming a suitable host with the gene for the fatty acid elongase and determining its effect on the fatty acid profile of the host.

The term "delta-9 elongase/delta-8 desaturase pathway" refers to a biosynthetic pathway for production of long-chain PUFAs. This pathway, at a minimum, comprises a delta-9 elongase and a delta-8 desaturase, thereby enabling biosynthesis of DGLA and/or ETA from LA and ALA, respectively.

The term "delta-9 elongase" refers to an enzyme that is capable of catalyzing at least one elongase reaction such as the elongation of linoleic or alpha-linolenic acid to EDA or ETrA, respectively. It may act as both a $C_{16/18}$ elongase and a $C_{18/20}$ elongase.

The term "amino acid" will refer to the basic chemical structural unit of a protein or polypeptide. Amino acids are identified by either the one-letter code or the three-letter codes for amino acids, in conformity with the IUPAC-IYUB standards described in *Nucleic Acids Research*, 13:3021-3030 (1985) and in the *Biochemical Journal*, 219 (2):345-373 (1984), which are herein incorporated by reference.

The term "conservative amino acid substitution" refers to a substitution of an amino acid residue in a given protein with another amino acid, without altering the chemical or functional nature of that protein. For example, it is well known in the art that alterations in a gene that result in the production of a chemically equivalent amino acid at a given site (but that do not affect the structural and functional properties of the encoded, folded protein) are common. For the purposes of the present invention, "conservative amino acid substitutions" are defined as exchanges within one of the following five groups:

1. small aliphatic, nonpolar or slightly polar residues: Ala [A], Ser [S], Thr [T] (Pro [P], Gly [G]);
2. polar, negatively charged residues and their amides; Asp [D], Asn [N], Glu [E], Gln [Q];
3. polar, positively charged residues: His [H], Arg [R], Lys [K];
4. large aliphatic, nonpolar residues: Met [M], Leu [L], Ile [I], Val [V] (Cys [C]); and,
5. large aromatic residues: Phe [F], Tyr [Y], Trp [W].

Conservative amino acid substitutions generally maintain: 1) the structure of the polypeptide backbone in the area of the substitution; 2) the charge or hydrophobicity of the molecule at the target site; or 3) the bulk of the side chain. Additionally, in many cases, alterations of the N-terminal and C-terminal portions of the protein molecule would also not be expected to alter the activity of the protein.

The term "non-conservative amino acid substitution" refers to an amino acid substitution that is generally expected to produce the greatest change in protein properties. Thus, for example, a non-conservative amino acid substitution would be one whereby: 1.) a hydrophilic residue is substituted for/by a hydrophobic residue (e.g., Ser or Thr for/by Leu, Ile, Val); 2.) a Cys or Pro is substituted for/by any other residue; 3.) a residue having an electropositive side chain is substituted for/by an electronegative residue (e.g., Lys, Arg or His for/by Asp or Glu); or, 4.) a residue having a bulky side chain is substituted for/by one not having a side chain (e.g., Phe for/by Gly). Sometimes, non-conservative amino acid substitutions between two of the five groups will not affect the activity of the encoded protein.

The terms "polynucleotide", "polynucleotide sequence", "nucleic acid sequence", "nucleic acid fragment" and "isolated nucleic acid fragment" are used interchangeably herein. These terms encompass nucleotide sequences and the like. A polynucleotide may be a polymer of RNA or DNA that is single- or double-stranded, that optionally contains synthetic, non-natural or altered nucleotide bases. A polynucleotide in the form of a polymer of DNA may be comprised of one or more segments of cDNA, genomic DNA, synthetic DNA, or mixtures thereof. Nucleotides (usually found in their 5'-monophosphate form) are referred to by a single letter designation as follows: "A" for adenylate or deoxyadenylate (for RNA or DNA, respectively), "C" for cytidylate or deoxycytidylate, "G" for guanylate or deoxyguanylate, "U" for uridylate, "T" for deoxythymidylate, "R" for purines (A or G), "Y" for pyrimidines (C or T), "K" for G or T, "H" for A or C or T, "I" for inosine, and "N" for any nucleotide.

The terms "subfragment that is functionally equivalent" and "functionally equivalent subfragment" are used interchangeably herein. These terms refer to a portion or subsequence of an isolated nucleic acid fragment in which the ability to alter gene expression or produce a certain phenotype is retained whether or not the fragment or subfragment encodes an active enzyme. For example, the fragment or subfragment can be used in the design of chimeric genes to produce the desired phenotype in a transformed plant. Chimeric genes can be designed for use in suppression by linking a nucleic acid fragment or subfragment thereof, whether or not it encodes an active enzyme, in the sense or antisense orientation relative to a plant promoter sequence.

The term "conserved domain" or "motif" means a set of amino acids conserved at specific positions along an aligned sequence of evolutionarily related proteins. While amino acids at other positions can vary between homologous proteins, amino acids that are highly conserved at specific positions indicate amino acids that are essential in the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family.

The terms "homology", "homologous", "substantially similar" and "corresponding substantially" are used interchangeably herein. They refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant invention such as deletion or insertion of one or more nucleotides that do not substantially alter the functional properties of the resulting nucleic acid fragment relative to the initial, unmodified fragment. It is therefore understood, as those skilled in the art will appreciate, that the invention encompasses more than the specific exemplary sequences.

Moreover, the skilled artisan recognizes that substantially similar nucleic acid sequences encompassed by this invention are also defined by their ability to hybridize (under moderately stringent conditions, e.g., +0.5×SSC, 0.1% SDS, 60° C.) with the sequences exemplified herein, or to any portion of the nucleotide sequences disclosed herein and which are functionally equivalent to any of the nucleic acid sequences disclosed herein. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, or 90% sequence identity, up to and including 100% sequence identity (i.e., fully complementary) with each other.

The term "stringent conditions" or "stringent hybridization conditions" includes reference to conditions under which a probe will selectively hybridize to its target sequence. Stringent conditions are sequence-dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length. Typically, stringent conditions will be those in which the salt concentration is less than about 1:5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Other exemplary stringent hybridization conditions include 0.1×SSC, 0.1% SDS, 65° C. and washed with 2×SSC, 0.1% SDS followed by 0.1×SSC, 0.1% SDS.

Specificity is typically the function of post-hybridization washes, the critical factors being the ionic strength and temperature of the final wash solution. For DNA-DNA hybrids, the $T_m$ can be approximated from the equation of Meinkoth et al., *Anal. Biochem.* 138:267-284 (1984): $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired identity. For example, if sequences with ≧90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/ or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution) it is preferred to increase the SSC concentration so that a higher temperature can be used. An extensive guide to the hybridization of nucleic acids is found in Tijssen, *Laboratory Techniques in Biochemistry and Molecular Biology—Hybridization with Nucleic Acid Probes*, Part I, Chapter 2 "Overview of principles of hybridization and the strategy of nucleic acid probe assays", Elsevier, New York (1993); and Current Protocols in Molecular Biology, Chapter 2, Ausubel et al., Eds., Greene Publishing and Wiley-Interscience, New York (1995). Hybridization and/or wash conditions can be applied for at least 10, 30, 60, 90, 120, or 240 minutes.

"Sequence identity" or "identity" in the context of nucleic acid or polypeptide sequences refers to the nucleic acid bases or amino acid residues in the two sequences that are the same when aligned for maximum correspondence over a specified comparison window.

Thus, "percentage of sequence identity" refers to the valued determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity. Useful examples of percent sequence identities include, but are not limited to, 50%, 55%, 60%, 65%, 70%, 75%, 80%, 85%, 90%, or 95%, or any integer percentage from 50% to 100%, such as such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. These identities can be determined using any of the programs described herein.

Sequence alignments and percent identity or similarity calculations may be determined using a variety of comparison methods designed to detect homologous sequences including, but not limited to, the MegAlign™ program of the LASARGENE bioinformatics computing suite (DNASTAR Inc., Madison, Wis.). Multiple alignment of the sequences are performed using the Clustal V method of alignment (Higgins, D. G. and Sharp, P. M. (1989) *Comput. Appl. Biosci.* 5:151-153; Higgins, D. G. et al. (1992) *Comput. Appl. Biosci.* 8:189-191) with the default parameters (GAP PENALTY=10, GAP LENGTH PENALTY=10). Default parameters for pairwise alignments and calculation of percent identity of protein sequences using the Clustal method are KTUPLE=1 GAP PENALTY=3, WINDOW=5 and DIAGONALS SAVED=5. For nucleic acids these parameters are KTUPLE=2, GAP PENALTY=5, WINDOW=4 and DIAGONALS SAVED=4.

It is well understood by one skilled in the art that many levels of sequence identity are useful in identifying polypeptides, from other species, wherein such polypeptides have the same or similar function or activity. Useful examples of percent identities include, but are not limited to, 50%, 55%, 60%, 65%, 70%, 75%, 80%, 85%, 90%, or 95%, or any integer percentage from 50% to 100%, such as such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Indeed, any integer amino acid identity from 50% to 100% may be useful in describing the present invention. Also, of interest is any full-length or partial complement of this isolated nucleotide fragment.

"Gene" refers to a nucleic acid fragment that expresses a specific protein, including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. A "foreign" gene refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

A "codon-optimized gene" is a gene having its frequency of codon usage designed to mimic the frequency of preferred codon usage of the host cell.

An "allele" is one of several alternative forms of a gene occupying a given locus on a chromosome. When all the alleles present at a given locus on a chromosome are the same that plant is homozygous at that locus. If the alleles present at a given locus on a chromosome differ that plant is heterozygous at that locus.

"Coding sequence" refers to a DNA sequence that codes for a specific amino acid sequence. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include, but are not limited to: promoters, translation leader sequences, introns, polyadenylation recognition sequences, RNA processing sites, effector binding sites and stem-loop structures.

"Promoter" refers to a DNA sequence capable of controlling the expression of a coding sequence or functional RNA. The promoter sequence consists of proximal and more distal upstream elements, the latter elements often referred to as enhancers. Accordingly, an "enhancer" is a DNA sequence that can stimulate promoter activity, and may be an innate element of the promoter or a heterologous element inserted to enhance the level or tissue-specificity of a promoter. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. It is further recognized that since in most cases the exact boundaries of regulatory sequences have not been completely defined, DNA fragments of some variation may have identical promoter activity. Promoters that cause a gene to be expressed in most cell types at most times are commonly referred to as "constitutive promoters". New promoters of various types useful in plant cells are constantly being discovered; numerous examples may be found in the compilation by Okamuro, J. K., and Goldberg, R. B. *Biochemistry of Plants* 15:1-82 (1989).

"Translation leader sequence" refers to a polynucleotide sequence located between the promoter sequence of a gene and the coding sequence. The translation leader sequence is present in the fully processed mRNA upstream of the translation start sequence. The translation leader sequence may affect processing of the primary transcript to mRNA, mRNA stability or translation efficiency. Examples of translation leader sequences have been described (Turner, R. and Foster, G. D., *Mol. Biotechnol.* 3:225-236 (1995)).

"3' non-coding sequences", "transcription terminator" or "termination sequences" refer to DNA sequences located downstream of a coding sequence and include polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht, I. L., et al. *Plant Cell* 1:671-680 (1989).

"RNA transcript" refers to the product resulting from RNA polymerase-catalyzed transcription of a DNA sequence. When the RNA transcript is a perfect complementary copy of the DNA sequence, it is referred to as the primary transcript. A RNA transcript is referred to as the mature RNA when it is a RNA sequence derived from post-transcriptional processing of the primary transcript. "Messenger RNA" or "mRNA" refers to the RNA that is without introns and that can be translated into protein by the cell. "cDNA" refers to a DNA that is complementary to, and synthesized from, a mRNA template using the enzyme reverse transcriptase. The cDNA can be single-stranded or converted into double-stranded form using the Klenow fragment of DNA polymerase I. "Sense" RNA refers to RNA transcript that includes the mRNA and can be translated into protein within a cell or in vitro. "Antisense RNA" refers to an RNA transcript that is complementary to all or part of a target primary transcript or mRNA, and that blocks the expression of a target gene (U.S. Pat. No. 5,107,065). The complementarity of an antisense RNA may be with any part of the specific gene transcript, i.e., at the 5' non-coding sequence, 3' non-coding sequence, introns, or the coding sequence. "Functional RNA" refers to antisense RNA, ribozyme RNA, or other RNA that may not be translated but yet has an effect on cellular processes. The terms "complement" and "reverse complement" are used interchangeably herein with respect to mRNA transcripts, and are meant to define the antisense RNA of the message.

The term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., the coding sequence is under the transcriptional control of the promoter). Coding sequences can be operably linked to regulatory sequences in a sense or antisense orientation. In another example, the complementary RNA regions of the invention can be operably linked, either directly or indirectly, 5' to the target mRNA, or 3' to the target mRNA, or within the target mRNA, or a first complementary region is 5' and its complement is 3' to the target mRNA.

Standard recombinant DNA and molecular cloning techniques used herein are well known in the art and are described more fully in Sambrook, J., Fritsch, E. F. and Maniatis, T. Molecular Cloning: A Laboratory Manual; Cold Spring Harbor Laboratory: Cold Spring Harbor, N.Y. (1989). Transformation methods are well known to those skilled in the art and are described below.

"PCR" or "polymerase chain reaction" is a technique for the synthesis of large quantities of specific DNA segments and consists of a series of repetitive cycles (Perkin Elmer Cetus Instruments, Norwalk, Conn.). Typically, the double-stranded DNA is heat denatured, the two primers complementary to the 3' boundaries of the target segment are annealed at low temperature and then extended at an intermediate temperature. One set of these three consecutive steps is referred to as a "cycle".

The term "recombinant" refers to an artificial combination of two otherwise separated segments of sequence, e.g., by chemical synthesis or by the manipulation of isolated segments of nucleic acids by genetic engineering techniques.

The terms "plasmid", "vector" and "cassette" refer to an extra chromosomal element often carrying genes that are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host.

The terms "recombinant construct", "expression construct", "chimeric construct", "construct", and "recombinant DNA construct" are used interchangeably herein. A recombinant construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the invention. The skilled artisan will also recognize that different independent transformation events will result in different levels and patterns of expression (Jones et al., *EMBO J.* 4:2411-2418 (1985); De Almeida et al., *Mol. Gen. Genetics* 218:78-86 (1989)), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others.

The term "expression", as used herein, refers to the production of a functional end-product (e.g., a mRNA or a protein [either precursor or mature]).

The term "expression cassette" as used herein, refers to a discrete nucleic acid fragment into which a nucleic acid sequence or fragment can be moved.

"Mature" protein refers to a post-translationally processed polypeptide (i.e., one from which any pre- or propeptides present in the primary translation product have been removed). "Precursor" protein refers to the primary product of translation of mRNA (i.e., with pre- and propeptides still present). Pre- and propeptides may be but are not limited to intracellular localization signals.

"Stable transformation" refers to the transfer of a nucleic acid fragment into a genome of a host organism, including both nuclear and organellar genomes, resulting in genetically stable inheritance. In contrast, "transient transformation" refers to the transfer of a nucleic acid fragment into the nucleus, or DNA-containing organelle, of a host organism resulting in gene expression without integration or stable inheritance. Host organisms containing the transformed nucleic acid fragments are referred to as "transgenic" organisms.

"Antisense inhibition" refers to the production of antisense RNA transcripts capable of suppressing the expression of the target protein. "Co-suppression" refers to the production of sense RNA transcripts capable of suppressing the expression of identical or substantially similar foreign or endogenous genes (U.S. Pat. No. 5,231,020). Co-suppression constructs in plants previously have been designed by focusing on overexpression of a nucleic acid sequence having homology to an endogenous mRNA, in the sense orientation, which results in the reduction of all RNA having homology to the overexpressed sequence (Vaucheret et al., *Plant J.* 16:651-659 (1998); Gura, *Nature* 404:804-808 (2000)). The overall efficiency of this phenomenon is low, and the extent of the RNA reduction is widely variable. Recent work has described the use of "hairpin" structures that incorporate all, or part, of an mRNA encoding sequence in a complementary orientation that results in a potential "stem-loop" structure for the expressed RNA (WO 99/53050, published Oct. 21, 1999; WO 02/00904, published Jan. 3, 2002). This increases the frequency of co-suppression in the recovered transgenic plants. Another variation describes the use of plant viral sequences to direct the suppression, or "silencing", of proximal mRNA encoding sequences (WO 98/36083, published Aug. 20, 1998). Both of these co-suppressing phenomena have not been elucidated mechanistically, although genetic evidence has begun to unravel this complex situation (Elmayan et al., *Plant Cell* 10:1747-1757 (1998)).

The term "oleaginous" refers to those organisms that tend to store their energy source in the form of lipid (Weete, In: Fungal Lipid Biochemistry, 2$^{nd}$ Ed., Plenum, 1980). Generally, the cellular oil content of these microorganisms follows a sigmoid curve, wherein the concentration of lipid increases until it reaches a maximum at the late logarithmic or early stationary growth phase and then gradually decreases during the late stationary and death phases (Yongmanitchai and Ward, *Appl. Environ. Microbiol.* 57:419-25 (1991)).

The term "oleaginous yeast" refers to those microorganisms classified as yeasts that make oil. It is not uncommon for oleaginous microorganisms to accumulate in excess of about 25% of their dry cell weight as oil. Examples of oleaginous yeast include, but are no means limited to, the following genera: *Yarrowia, Candida, Rhodotorula, Rhodosporidium, Cryptococcus, Trichosporon* and *Lipomyces*.

The "Clustal V method of alignment" corresponds to the alignment method labeled Clustal V (described by Higgins and Sharp, *CABIOS*. 5:151-153 (1989)) and found in the MegAlign™ program of the LASERGENE bioinformatics computing suite (DNASTAR Inc., Madison, Wis.). The "default parameters" are the parameters preset by the manufacturer of the program. For multiple alignments, they correspond to GAP PENALTY=10 and GAP LENGTH PENALTY=10; and, for pairwise alignments, they are KTUPLE 1, GAP PENALTY=3, WINDOW=5 and DIAGONALS SAVED=5. After alignment of the sequences using the Clustal V program, it is possible to obtain a "percent identity" by viewing the "sequence distances" table in the same program.

"BLASTN method of alignment" is an algorithm provided by the National Center for Biotechnology Information (NCBI) to compare nucleotide sequences using default parameters.

The present invention concerns an isolated polynucleotide comprising:
  (a) a nucleotide sequence encoding a polypeptide having delta-9 elongase activity, wherein the polypeptide has at least 70% amino acid identity, based on the Clustal V method of alignment, when compared to an amino acid sequence as set forth in SEQ ID NO:5 or SEQ ID NO:127;
  (b) a nucleotide sequence encoding a polypeptide having delta-9 elongase activity, wherein the nucleotide sequence has at least 70% sequence identity, based on the BLASTN method of alignment, when compared to a nucleotide sequence as set forth in SEQ ID NO:4, SEQ ID NO:90 or SEQ ID NO:126;
  (c) a nucleotide sequence encoding a polypeptide having delta-9 elongase activity, wherein the nucleotide sequence hybridizes with a nucleotide sequence as set forth in SEQ ID NO:4, SEQ ID NO:90 or SEQ ID NO:126 under the following stringent hybridization conditions: 0.1×SSC, 0.1% SDS, 65° C. and washed with 2×SSC, 0.1% SDS followed by 0.1×SSC, 0.1% SDS; or
  (d) a complement of the nucleotide sequence of (a), (b) or (c), wherein the complement and the nucleotide sequence consist of the same number of nucleotides and are 100% complementary.

In another aspect this invention concerns an isolated nucleic acid fragment comprising a nucleic acid sequence encoding a delta-9 elongase, excluding SEQ ID NO:27, wherein the amino acid sequence comprising said elongase contains at least one of the following amino acid sequence motifs selected from the group consisting of:

```
                                          (SEQ ID NO:130)
a) Y N X (L or F)  X X X X S X X S F;

(SEQ ID NO:131)
b) F Y X S K X X (E or D) Y X D (T or S) X X L;

(SEQ ID NO:132)
c) L (Q or H) X F H H X G A;

(SEQ ID NO:133)
d) M Y X Y Y X X X X X X (K or R or N) F;
```

```
                                                             (SEQ ID NO:134)
e) K X L (I or L or M) T X X Q;

(SEQ ID NO:135)
f) W X F N Y X Y;
and (SEQ ID NO:136)
g) Y X G X V X X L F;
``` wherein X can be any amino acid.

The underlined amino acids may be unique to delta-9 elongases. FIG. 16 (see also FIG. 29) sets forth a comparison of the delta-9 elongase of the invention with a delta-9 elongase from *Isochrysis galbana* using Clustal V alignment (with default parameters). Specifically, SEQ ID NO:5 (amino acid sequence of the delta-9 elongase of the instant invention) and SEQ ID NO:27 (amino acid sequence of the long-chain PUFA elongation enzyme from *Isochrysis galbana* (NCBI Accession No. AAL37626 (GI 17226123)) were compared.

In still another aspect, this invention concerns an isolated polynucleotide comprising a nucleotide sequence encoding a polypeptide having delta-9 elongase activity, wherein the nucleotide sequence has at least 84% sequence identity, based on the BLASTN method of alignment, when compared to a nucleotide sequence as set forth in SEQ ID NO:4.

It was found that a comparison of SEQ ID NO:4 and SEQ ID NO:90 using the BLASTN method of alignment with default parameters showed that these sequences had at least 84% sequence identity.

This delta-9 elongase may be used alone or in combination with other desaturase and elongase components to produce various omega-6 and omega-3 PUFAs, including e.g., DGLA, ETA, AA, EPA, DPA and/or DHA (FIG. 15). One skilled in the art will recognize the appropriate combinations of the delta-9 elongase of the invention herein in conjunction with a delta-4 desaturase, a delta-5 desaturase, a delta-6 desaturase, a delta-12 desaturase, a delta-15 desaturase, a delta-17 desaturase, a delta-9 desaturase, a delta-8 desaturase, a C$_{14/16}$ elongase, a C$_{16/18}$ elongase, a C$_{18/20}$ elongase and/or a C$_{20/22}$ elongase, based on the particular host cell (and its native PUFA profile and/or desaturase and/or elongase profile), the availability of substrate, and the desired end product(s).

In another embodiment, this invention concerns a recombinant construct comprising the polynucleotide of the invention operably linked to at least one regulatory sequence.

As was noted above, a promoter is a DNA sequence that directs cellular machinery of a plant to produce RNA from the contiguous coding sequence downstream (3') of the promoter. The promoter region influences the rate, developmental stage, and cell type in which the RNA transcript of the gene is made. The RNA transcript is processed to produce mRNA which serves as a template for translation of the RNA sequence into the amino acid sequence of the encoded polypeptide. The 5' non-translated leader sequence is a region of the mRNA upstream of the protein coding region that may play a role in initiation and translation of the mRNA. The 3' transcription termination/polyadenylation signal is a non-translated region downstream of the protein coding region that functions in the plant cell to cause termination of the RNA transcript and the addition of polyadenylate nucleotides to the 3' end of the RNA.

The origin of the promoter chosen to drive expression of the coding sequence is not important as long as it has sufficient transcriptional activity to accomplish the invention by expressing translatable mRNA for the desired nucleic acid fragments in the desired host tissue at the right time. Either heterologous or non-heterologous (i.e., endogenous) promoters can be used to practice the invention. For example, suitable promoters include, but are not limited to: the alpha prime subunit of beta conglycinin promoter, Kunitz trypsin inhibitor 3 promoter, annexin promoter, Gly1 promoter, beta subunit of beta conglycinin promoter, P34/Gly Bd m 30K promoter, albumin promoter, Leg A1 promoter and Leg A2 promoter.

The annexin, or P34, promoter is described in WO 2004/071178 (published Aug. 26, 2004). The level of activity of the annexin promoter is comparable to that of many known strong promoters, such as: (1) the CaMV 35S promoter (Atanassova et al., *Plant Mol. Biol.* 37:275-285 (1998); Battraw and Hall, *Plant Mol. Biol.* 15:527-538 (1990); Holtorf et al., *Plant Mol. Biol.* 29:637-646 (1995); Jefferson et al., *EMBO J.* 6:3901-3907 (1987); Wilmink et al., *Plant Mol. Biol.* 28:949-955 (1995)); (2) the *Arabidopsis* oleosin promoters (Plant et al., *Plant Mol. Biol.* 25:193-205 (1994); Li, Texas A&M University Ph.D. dissertation, pp. 107-128 (1997)); (3) the *Arabidopsis* ubiquitin extension protein promoters (Callis et al., *J. Biol. Chem.* 265(21):12486-93 (1990)); (4) a tomato ubiquitin gene promoter (Rollfinke et al., *Gene.* 211(2):267-76 (1998)); (5) a soybean heat shock protein promoter (Schoffl et al., *Mol Gen Genet.* 217(2-3):246-53 (1989)); and, (6) a maize H3 histone gene promoter (Atanassova et al., *Plant Mol. Biol.* 37(2):275-85 (1989)).

Another useful feature of the annexin promoter is its expression profile in developing seeds. The annexin promoter is most active in developing seeds at early stages (before 10 days after pollination) and is largely quiescent in later stages. The expression profile of the annexin promoter is different from that of many seed-specific promoters, e.g., seed storage protein promoters, which often provide highest activity in later stages of development (Chen et al., *Dev. Genet.* 10:112-122 (1989); Ellerstrom et al., *Plant Mol. Biol.* 32:1019-1027 (1996); Keddie et al., *Plant Mol. Biol.* 24:327-340 (1994); Plant et al., (supra); Li, (supra)). The annexin promoter has a more conventional expression profile but remains distinct from other known seed specific promoters. Thus, the annexin promoter will be a very attractive candidate when overexpression, or suppression, of a gene in embryos is desired at an early developing stage. For example, it may be desirable to overexpress a gene regulating early embryo development or a gene involved in the metabolism prior to seed maturation.

Following identification of an appropriate promoter suitable for expression of a specific coding sequence, the promoter is then operably linked in a sense orientation using conventional means well known to those skilled in the art.

Standard recombinant DNA and molecular cloning techniques used herein are well known in the art and are described more fully in Sambrook, J. et al., In *Molecular Cloning: A Laboratory Manual*, 2$^{nd}$ ed.; Cold Spring Harbor Laboratory Press: Cold Spring Harbor, New York, 1989 (hereinafter "Sambrook et al., 1989") or Ausubel, F. M., Brent, R., Kingston, R. E., Moore, D. D., Seidman, J. G., Smith, J. A. and Struhl, K., Eds.; In *Current Protocols in Molecular Biology*, John Wiley and Sons: New York, 1990 (hereinafter "Ausubel et al., 1990").

Once the recombinant construct has been made, it may then be introduced into a plant cell of choice by methods well known to those of ordinary skill in the art (e.g., transfection, transformation and electroporation). Oilseed plant cells are the preferred plant cells. The transformed plant cell is then cultured and regenerated under suitable conditions permitting expression of the long-chain PUFA which is then optionally recovered and purified.

The recombinant constructs of the invention may be introduced into one plant cell; or, alternatively, each construct may be introduced into separate plant cells.

Expression in a plant cell may be accomplished in a transient or stable fashion as is described above.

The desired long-chain PUFAs can be expressed in seed. Also within the scope of this invention are seeds or plant parts obtained from such transformed plants.

The term "plant" refers to whole plants, plant organs, plant tissues, seeds, plant cells, seeds and progeny of the same. Plant cells include, without limitation, cells from seeds, suspension cultures, embryos, meristematic regions, callus tissue, leaves, roots, shoots, gametophytes, sporophytes, pollen and microspores.

"Progeny" comprises any subsequent generation of a plant.

Plant parts include differentiated and undifferentiated tissues including, but not limited to the following: roots, stems, shoots, leaves, pollen, seeds, tumor tissue and various forms of cells and culture (e.g., single cells, protoplasts, embryos and callus tissue). The plant tissue may be in plant or in a plant organ, tissue or cell culture.

The term "plant organ" refers to plant tissue or group of tissues that constitute a morphologically and functionally distinct part of a plant. The term "genome" refers to the following: (1) the entire complement of genetic material (genes and non-coding sequences) is present in each cell of an organism, or virus or organelle; (2) a complete set of chromosomes inherited as a (haploid) unit from one parent.

Thus, this invention also concerns a method for transforming a cell, comprising transforming a cell with the recombinant construct of the invention and selecting those cells transformed with the recombinant construct of claim 5.

Also of interest is a method for producing a transformed plant comprising transforming a plant cell with the polynucleotide of the instant invention and regenerating a plant from the transformed plant cell.

Methods for transforming dicots (primarily by use of *Agrobacterium tumefaciens*) and obtaining transgenic plants have been published, among others, for: cotton (U.S. Pat. Nos. 5,004,863; 5,159,135); soybean (U.S. Pat. Nos. 5,569,834; 5,416,011); *Brassica* (U.S. Pat. No. 5,463,174); peanut (Cheng et al. *Plant Cell Rep.* 15:653-657 (1996); McKently et al. *Plant Cell Rep.* 14:699-703 (1995)); papaya (Ling, K. et al. *Bio/technology* 9:752-758 (1991)); and pea (Grant et al. *Plant Cell Rep.* 15:254-258 (1995)). For a review of other commonly used methods of plant transformation see Newell, C. A. (*Mol. Biotechnol.* 16:53-65 (2000)). One of these methods of transformation uses *Agrobacterium rhizogenes* (Tepfler, M. and Casse-Delbart, F. *Microbiol.* Sci. 4:24-28 (1987)). Transformation of soybeans using direct delivery of DNA has been published using PEG fusion (WO 92/17598), electroporation (Chowrira, G. M. et al. *Mol. Biotechnol.* 3:17-23 (1995); Christou, P. et al. *Proc. Natl. Acad. Sci. U.S.A.* 84:3962-3966 (1987)), microinjection, or particle bombardment (McCabe, D. E. et. al. *Bio/Technology* 6:923 (1988); Christou et al. *Plant Physiol.* 87:671-674 (1988)).

There are a variety of methods for the regeneration of plants from plant tissue. The particular method of regeneration will depend on the starting plant tissue and the particular plant species to be regenerated. The regeneration, development and cultivation of plants from single plant protoplast transformants or from various transformed explants is well-known in the art (Weissbach and Weissbach, In: Methods for Plant Molecular Biology, (Eds.), Academic: San Diego, Calif. (1988)). This regeneration and growth process typically includes the steps of selection of transformed cells and culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant DNA fragments and recombinant expression constructs and the screening and isolating of clones. See, for example: Sambrook et al., Molecular Cloning: A Laboratory Manual, Cold Spring Harbor: NY (1989); Maliga et al., Methods in Plant Molecular Biology, Cold Spring Harbor: NY (1995); Birren et al., Genome Analysis: Detecting Genes, Vol. 1, Cold Spring Harbor: NY (1998); Birren et al., Genome Analysis: Analyzing DNA, Vol. 2, Cold Spring Harbor: NY (1998); Plant Molecular Biology: A Laboratory Manual, eds. Clark, Springer: NY (1997).

Examples of oilseed plants include, but are not limited to, soybean, *Brassica* species, sunflower, maize, cotton, flax and safflower.

Examples of polyunsaturated fatty acids having at least twenty carbon atoms and five or more carbon-carbon-double bonds include, but are not limited to, omega-3 fatty acids such as EPA, DPA and DHA. Seeds obtained from such plants are also within the scope of this invention as well as oil obtained from such seeds.

In one embodiment this invention concerns an oilseed plant comprising: a) a first recombinant DNA construct comprising an isolated polynucleotide encoding a delta-9 elongase polypeptide, operably linked to at least one regulatory sequence; and b) at least one additional recombinant DNA construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-9 desaturase, a delta-12 desaturase, a delta-15 desaturase, and a delta-17 desaturase, a C$_{18/20}$ elongase and a C$_{20/22}$ elongase.

Such desaturases are discussed, for example, in U.S. Pat. Nos. 6,075,183, 5,968,809, 6,136,574, 5,972,664, 6,051,754, 6,410,288 and WO 98/46763, WO 98/46764, WO 00/12720 and WO 00/40705.

The choice of combination of cassettes used depends in part on the PUFA profile and/or desaturase/elongase profile of the oilseed plant cells to be transformed and the long-chain PUFA which is to be expressed.

In another aspect, this invention concerns a method for making long-chain polyunsaturated fatty acids in a plant cell comprising:
 (a) transforming a cell with the recombinant construct of the invention; and
 (b) selecting those transformed cells that make long-chain polyunsaturated fatty acids.

In still another aspect, this invention concerns a method for producing at least one polyunsaturated fatty acid in a soybean cell comprising:

(a) transforming a soybean cell with a first recombinant DNA construct comprising an isolated polynucleotide encoding a delta-9 elongase polypeptide, operably linked to at least one regulatory sequence and at least one additional recombinant DNA construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-9 desaturase, a delta-12 desaturase, a delta-15 desaturase, and a delta-17 desaturase, a C $C_{18/20}$ elongase and a C $C_{20/22}$ elongase;

(b) regenerating a soybean plant from the transformed cell of step (a); and (c) selecting those seeds obtained from the plants of step (b) having an altered level of polyunsaturated fatty acids when compared to the level in seeds obtained from a nontransformed soybean plant.

Methods of isolating seed oils are well known in the art: (Young et al., Processing of Fats and Oils, In *The Lipid Handbook*, Gunstone et al., eds., Chapter 5 pp 253-257; Chapman & Hall: London (1994)). For example, soybean oil is produced using a series of steps involving the extraction and purification of an edible oil product from the oil-bearing seed. Soybean oils and soybean byproducts are produced using the generalized steps shown in Table 3.

TABLE 3

Generalized Steps for Soybean Oil and Byproduct Production

| Process Step | Process | Impurities Removed and/or By-Products Obtained |
|---|---|---|
| #1 | soybean seed | |
| #2 | oil extraction | meal |
| #3 | degumming | lecithin |
| #4 | alkali or physical refining | gums, free fatty acids, pigments |
| #5 | water washing | soap |
| #6 | bleaching | color, soap, metal |
| #7 | (hydrogenation) | |
| #8 | (winterization) | stearine |
| #9 | deodorization | free fatty acids, tocopherols, sterols, volatiles |
| #10 | oil products | |

More specifically, soybean seeds are cleaned, tempered, dehulled and flaked, thereby increasing the efficiency of oil extraction. Oil extraction is usually accomplished by solvent (e.g., hexane) extraction but can also be achieved by a combination of physical pressure and/or solvent extraction. The resulting oil is called crude oil. The crude oil may be degummed by hydrating phospholipids and other polar and neutral lipid complexes that facilitate their separation from the nonhydrating, triglyceride fraction (soybean oil). The resulting lecithin gums may be further processed to make commercially important lecithin products used in a variety of food and industrial products as emulsification and release (i.e., antisticking) agents. Degummed oil may be further refined for the removal of impurities (primarily free fatty acids, pigments and residual gums). Refining is accomplished by the addition of a caustic agent that reacts with free fatty acid to form soap and hydrates phosphatides and proteins in the crude oil. Water is used to wash out traces of soap formed during refining. The soapstock byproduct may be used directly in animal feeds or acidulated to recover the free fatty acids. Color is removed through adsorption with a bleaching earth that removes most of the chlorophyll and carotenoid compounds. The refined oil can be hydrogenated, thereby resulting in fats with various melting properties and textures. Winterization (fractionation) may be used to remove stearine from the hydrogenated oil through crystallization under carefully controlled cooling conditions. Deodorization (principally via steam distillation under vacuum) is the last step and is designed to remove compounds which impart odor or flavor to the oil. Other valuable byproducts such as tocopherols and sterols may be removed during the deodorization process. Deodorized distillate containing these byproducts may be sold for production of natural vitamin E and other high-value pharmaceutical products. Refined, bleached, (hydrogenated, fractionated) and deodorized oils and fats may be packaged and sold directly or further processed into more specialized products. A more detailed reference to soybean seed processing, soybean oil production and byproduct utilization can be found in Erickson, Practical Handbook of Soybean Processing and Utilization, The American Oil Chemists' Society and United Soybean Board (1995).

Soybean oil is liquid at room temperature because it is relatively low in saturated fatty acids when compared with oils such as coconut, palm, palm kernel and cocoa butter. Many processed fats (including spreads, confectionary fats, hard butters, margarines, baking shortenings, etc.) require varying degrees of solidity at room temperature and can only be produced from soybean oil through alteration of its physical properties. This is most commonly achieved through catalytic hydrogenation.

Hydrogenation is a chemical reaction in which hydrogen is added to the unsaturated fatty acid double bonds with the aid of a catalyst such as nickel. High oleic soybean oil contains unsaturated oleic, LA and linolenic fatty acids and each of these can be hydrogenated. Hydrogenation has two primary effects. First, the oxidative stability of the oil is increased as a result of the reduction of the unsaturated fatty acid content. Second, the physical properties of the oil are changed because the fatty acid modifications increase the melting point resulting in a semi-liquid or solid fat at room temperature.

There are many variables which affect the hydrogenation reaction, which in turn alter the composition of the final product. Operating conditions including pressure, temperature, catalyst type and concentration, agitation and reactor design are among the more important parameters that can be controlled. Selective hydrogenation conditions can be used to hydrogenate the more unsaturated fatty acids in preference to the less unsaturated ones. Very light or brush hydrogenation is often employed to increase stability of liquid oils. Further hydrogenation converts a liquid oil to a physically solid fat. The degree of hydrogenation depends on the desired performance and melting characteristics designed for the particular end product. Liquid shortenings (used in the manufacture of baking products, solid fats and shortenings used for commercial frying and roasting operations) and base stocks for margarine manufacture are among the myriad of possible oil and fat products achieved through hydrogenation. A more detailed description of hydrogenation and hydrogenated products can be found in Patterson, H. B. W., Hydrogenation of Fats and Oils: Theory and Practice. The American Oil Chemists' Society (1994).

Hydrogenated oils have also become controversial due to the presence of trans-fatty acid isomers that result from the hydrogenation process. Ingestion of large amounts of trans-isomers has been linked with detrimental health effects including increased ratios of low density to high density lipoproteins in the blood plasma and increased risk of coronary-heart disease.

Compared to other vegetable oils, the oils of the invention are believed to function similarly to other oils in food applications from a physical standpoint. Partially hydrogenated oils, such as soybean oil, are widely used as ingredients for soft spreads, margarine and shortenings for baking and frying.

In general, lipid accumulation in oleaginous microorganisms is triggered in response to the overall carbon to nitrogen ratio present in the growth medium. This process, leading to the de novo synthesis of free palmitate (16:0) in oleaginous microorganisms, is described in detail in WO 2004/101757. Palmitate is the precursor of longer-chain saturated and unsaturated fatty acid derivates, which are formed through the action of elongases and desaturases. For example, palmitate is converted to its unsaturated derivative (palmitoleic acid (16:1)) by the action of a delta-9 desaturase. Similarly, palmitate is elongated by a C $C_{16/18}$ fatty acid elongase to form stearic acid (18:0), which can be converted to its unsaturated derivative by a delta-9 desaturase to thereby yield oleic acid (18:1).

Triacylglycerols (the primary storage unit for fatty acids) are formed by the esterification of two molecules of acyl-CoA to glycerol-3-phosphate to yield 1,2-diacylglycerol phosphate (commonly identified as phosphatidic acid). The phosphate is then removed, by phosphatidic acid phosphatase, to yield 1,2-diacylglycerol. Triacylglycerol is formed upon the addition of a third fatty acid by the action of a diacylglycerol-acyl transferase.

Many microorganisms, including algae, bacteria, molds and yeasts, can synthesize PUFAs and omega fatty acids in the ordinary course of cellular metabolism. Particularly well-studied are fungi including Schizochytrium aggregatm, species of the genus Thraustochytrium and Morteriella alpina. Additionally, many dinoflagellates (Dinophyceaae) naturally produce high concentrations of PUFAs. As such, a variety of genes involved in oil production have been identified through genetic means and the DNA sequences of some of these genes are publicly available. See, for example, AY131238, Y055118, AY055117, AF296076, AF007561, Li 1421, NM_031344, AF465283, AF465281, AF110510, AF465282, AF419296, AB052086, AJ250735, AF126799, AF126798 (delta-6 desaturases); AF199596, AF226273, AF320509, AB072976, AF489588, AJ510244, AF419297, AF07879, AF067654, AB022097 (delta-5 desaturases); AAG36933, AF110509, AB020033, AAL13300, AF417244, AF161219, AY332747, AAG36933, AF110509, X86736, AF240777, AB007640, AB075526, AP002063 (delta-12 desaturases); NP_441622, BAA18302, BAA02924, AAL36934 (delta-15 desaturases); AF338466, AF438199, E11368, E11367, D83185, U90417, AF085500, AY504633, NM_069854, AF230693 (delta-9 desaturases); AF390174 (delta-9 elongase); AF139720 and CQ831420 (delta-8 desaturase); and AX464731, NM_119617, NM_134255, NM_134383, NM_134382, NM_068396, NM_068392, NM_070713, NM_068746, NM_064685 (elongases).

Additionally, the patent literature provides many additional DNA sequences of genes (and/or details concerning several of the genes above and their methods of isolation) involved in PUFA production (e.g., WO 02/077213 (delta-9 elongases); WO 00/34439, WO 04/057001 and U.S. Pat. No. 6,825,017 (delta-8 desaturases); U.S. Pat. No. 5,968,809 (delta-6 desaturases); U.S. Pat. Nos. 5,972,664 and 6,075,183 (delta-5 desaturases); WO 94/11516, U.S. Pat. No. 5,443,974, WO 03/099216 and WO 05/047485 (delta-12 desaturases); WO 93/11245 (delta-15 desaturases); WO 91/13972 and U.S. Pat. No. 5,057,419 (delta-9 desaturases); U.S. Patent Application Publication No. 2003/0196217 A1 (delta-17 desaturase); and WO 00/12720 and WO 2002/077213, U.S. Pat. Nos. 6,403,349, 6,677,145, and U.S. Patent Application Publication No. 2004/0111763 ($C_{14/16}$, $C_{16/18}$ and $C_{18/20}$ elongases)). Each of these patents and applications are herein incorporated by reference in their entirety.

As will be obvious to one skilled in the art, the particular functionalities required to be introduced into a microbial host organism for production of a particular PUFA final product will depend on the host cell (and its native PUFA profile and/or desaturase/elongase profile), the availability of substrate and the desired end product(s). LA, GLA, EDA, DGLA, M, ALA, STA, ETrA, ETA, EPA, DPA and DHA may all be produced in oleaginous yeasts, by introducing various combinations of the following PUFA enzyme functionalities: a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C $C_{14/16}$ elongase, a $C_{16/18}$ elongase, a C $C_{18/20}$ elongase and/or a C $C_{20/22}$ elongase. One skilled in the art will be able to identify various candidate genes encoding each of the above enzymes, according to publicly available literature e.g., GenBank); the patent literature, and experimental analysis of microorganisms having the ability to produce PUFAs. The sequences may be derived from any source, e.g., isolated from a natural source (from bacteria, algae, fungi, plants, animals, etc.), produced via a semi-synthetic route or synthesized de novo. In some embodiments, manipulation of genes endogenous to the host is preferred; for other purposes, it is necessary to introduce heterologous genes.

Although the particular source of the desaturase and elongase genes introduced into the host is not critical to the invention, considerations for choosing a specific polypeptide having desaturase or elongase activity include (1) the substrate specificity of the polypeptide, (2) whether the polypeptide or a component thereof is a rate-limiting enzyme, (3) whether the desaturase or elongase is essential for synthesis of a desired PUFA, and/or (4) co-factors required by the polypeptide. The expressed polypeptide preferably has parameters compatible with the biochemical environment of its location in the host cell. For example, the polypeptide may have to compete for substrate with other enzymes in the host cell. Analyses of the $K_M$ and specific activity of the polypeptide are therefore considered in determining the suitability of a given polypeptide for modifying PUFA production in a given host cell. The polypeptide used in a particular host cell is one that can function under the biochemical conditions present in the intended host cell but otherwise can be any polypeptide having desaturase or elongase activity capable of modifying the desired PUFA.

In some cases, the host organism in which it is desirable to produce PUFAs will possess endogenous genes encoding some PUFA biosynthetic pathway enzymes. For example, oleaginous yeast can typically produce 18:2 fatty acids (and some have the additional capability of synthesizing 18:3 fatty acids); thus, oleaginous yeast typically possess native delta-12 desaturase activity and may also have delta-15 desaturases. In some embodiments, therefore, expression of the native desaturase enzyme is preferred over a heterologous (or "foreign") enzyme since (1) the native enzyme is optimized for interaction with other enzymes and proteins within the cell, and (2) heterologous genes are unlikely to share the same codon preference in the host organism. Additionally, advantages are incurred when the sequence of the native gene is known; as it permits facile disruption of the endogenous gene by targeted disruption.

In many instances, however, the appropriate desaturases and elongases are not present in the host organism of choice to enable production of the desired PUFA products. Thus, it is necessary to introduce heterologous genes. In one embodiment of the present invention, work was conducted toward the goal of the development of an oleaginous yeast that accumulates oils enriched in long-chain omega-3 and/or omega-6 fatty acids via expression of a delta-9 elongase/delta-8 desaturase pathway, to enable production of EDA, DGLA, ARA, ALA, ETrA, ETA, EPA, DPA and/or DHA.

In order to express genes encoding the delta-9 elongase/delta-8 desaturase pathway for the biosynthesis of long-chain PUFAs (e.g., M and EPA) in these organisms, it was therefore necessary to (1) identify a suitable delta-9 elongase and delta-8 desaturase that functioned relatively efficiently in oleaginous yeast based on substrate-feeding trials, and, (2) subject the delta-9 elongase and delta-9 desaturase gene to codon-optimization techniques (infra) to further enhance the expression of the heterologous enzymes in the alternate oleaginous yeast host, to thereby enable maximal production of omega-3 and/or omega-6 fatty acids.

It will be obvious to one of skill in the art that heterologous genes will be expressed with variable efficiencies in an alternate host. Thus, omega-3 and/or omega-6 PUFA production may be optimized by selection of a particular desaturase or elongase whose level of expression in a heterologous host is preferred relative to the expression of an alternate desaturase or elongase in the host organism of interest. Furthermore, it may be desirable to modify the expression of particular PUFA biosynthetic pathway enzymes to achieve optimal conversion efficiency of each, according to the specific PUFA product composition of interest. A variety of genetic engineering techniques are available to optimize expression of a particular enzyme. Two such techniques include codon optimization and gene mutation, as described below. Genes produced by, for example, either of these two methods, having desaturase and/or elongase activity(s) would be useful in the invention herein for synthesis of omega-3 and/or omega-6 PUFAs.

As will be appreciated by one skilled in the art, it is frequently useful to modify a portion of the codons encoding a particular polypeptide that is to be expressed in a foreign host, such that the modified polypeptide uses codons that are preferred by the alternate host. Use of host-preferred codons can substantially enhance the expression of the foreign gene encoding the polypeptide.

In general, host-preferred codons can be determined within a particular host species of interest by examining codon usage in proteins (preferably those expressed in the largest amount) and determining which codons are used with highest frequency. Then, the coding sequence for a polypeptide of interest having desaturase or elongase activity can be synthesized in whole or in part using the codons preferred in the host species. All (or portions) of the DNA also can be synthesized to remove any destabilizing sequences or regions of secondary structure that would be present in the transcribed mRNA. All (or portions) of the DNA also can be synthesized to alter the base composition to one more preferable in the desired host cell.

In the present invention, it is desirable to modify a portion of the codons encoding the polypeptide having delta-9 elongase activity, to enhance the expression of the gene in a host organism including, but not limited to, a plant, plant parts and/or oleaginous yeast *Yarrowia lipolytica*. The nucleic acid sequence of the native gene (i.e., the *Euglena gracilis* delta-9 elongase defined herein as SEQ ID NOs:3 and 4) is modified to employ host-preferred codons. This wildtype elongase has 258 amino acids (SEQ ID NO:5); in the codon-optimized gene (SEQ ID NO:90), 117 bp of the 777 bp coding region (15.1%) and 106 codons) are codon-optimized (41.1%) and the translation initiation site is modified.

The skilled artisan will appreciate that modulation of the *Euglena gracilis* delta-9 elongase as well as numerous other heterologous delta-9 elongases from variable sources can be codon-optimized to improve their expression in an oleaginous yeast host (e.g., see Example 4 herein, wherein a synthetic codon-optimized delta-9 elongase derived from *Isochrysis galbana* was created for expression in *Yarrowia lipolytica*). The present invention comprises the complete sequence of the synthetic codon-optimized gene as reported in the accompanying Sequence Listing (SEQ ID NO:90), the complement of those complete sequences, and substantial portions of those sequences. Furthermore, the codon-optimization method described in WO 2004/101753 and described herein for optimization of the *Euglena gracilis* delta-9 elongase is equally applicable to other genes in the omega-3/omega-6 fatty acid biosynthetic pathway.

Methods for synthesizing sequences and bringing sequences together are well established in the literature. For example, in vitro mutagenesis and selection, site-directed mutagenesis, error prone PCR (Melnikov et al., *Nucleic Acids Research*, 27(4):1056-1062 (February 1999)), "gene shuffling" or other means can be employed to obtain mutations of naturally occurring desaturase or elongase genes (wherein such mutations may include deletions, insertions and point mutations, or combinations thereof). This would permit production of a polypeptide having desaturase or elongase activity, respectively, in vivo with more desirable physical and kinetic parameters for function in the host cell such as a longer half-life or a higher rate of production of a desired PUFA. Or, if desired, the regions of a polypeptide of interest (i.e., a desaturase or an elongase) important for enzymatic activity can be determined through routine mutagenesis, expression of the resulting mutant polypeptides and determination of their activities. An overview of these techniques are described in WO 2004/101757. All such mutant proteins and nucleotide sequences encoding them that are derived from the codon-optimized gene described herein are within the scope of the present invention.

Microbial production of omega-3 and/or omega-6 fatty acids has several advantages. For example, (1) many microbes are known with greatly simplified oil compositions compared with those of higher organisms, making purification of desired components easier, (2) microbial production is not subject to fluctuations caused by external variables, such as weather and food supply, (3) microbially produced oil is substantially free of contamination by environmental pollutants, (4) microbes can provide PUFAs in particular forms which may have specific uses, and (5) microbial oil production can be manipulated by controlling culture conditions, notably by providing particular substrates for microbially expressed enzymes, or by addition of compounds/genetic engineering to suppress undesired biochemical pathways.

In addition to these advantages, production of omega-3 and/or omega-6 fatty acids from recombinant microbes provides the ability to alter the naturally occurring microbial fatty acid profile by providing new biosynthetic pathways in the host or by suppressing undesired pathways, thereby increasing levels of desired PUFAs, or conjugated forms thereof, and decreasing levels of undesired PUFAs. For example, it is possible to modify the ratio of omega-3 to omega-6 fatty acids so produced, produce either omega-3 or omegas fatty acids exclusively while eliminating production of the alternate omega fatty acid, or engineer production of a specific PUFA without significant accumulation of other PUFA downstream or upstream products (e.g., enable biosynthesis of M, EPA and/or DHA via the delta-9 elongase/delta-8 desaturase pathway, thereby avoiding synthesis of GLA and/or STA).

The genes and gene products described herein may be produced in heterologous microbial host cells, particularly in the cells of oleaginous yeasts (e.g., *Yarrowia lipolytica*). Expression in recombinant microbial hosts may be useful for the production of various PUFA pathway intermediates, or for the modulation of PUFA pathways already existing in the host for the synthesis of new products heretofore not possible using the host.

Microbial expression systems and expression vectors containing regulatory sequences that direct high level expression of foreign proteins are well known to those skilled in the art. Any of these could be used to construct chimeric genes for production of any of the gene products of the preferred desaturase and/or elongase sequences. These chimeric genes could then be introduced into appropriate microorganisms via transformation to provide high-level expression of the encoded enzymes.

Accordingly, it is expected that introduction of chimeric genes encoding a PUFA biosynthetic pathway, under the control of the appropriate promoters will result in increased production of omega-3 and/or omega-6 fatty acids. It is contemplated that it will be useful to express various combinations of these PUFA desaturase and elongase genes together in a host microorganism. It will be obvious to one skilled in the art that the particular genes included within a particular expression cassette(s) will depend on the host cell, its ability to synthesize PUFAs using native desaturases and elongases, the availability of substrate and the desired end product(s). For example, it may be desirable for an expression cassette to be constructed comprising genes encoding one or more of the following enzymatic activities: a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a $C_{14/16}$ elongase, a $C_{16/18}$ elongase, a $C_{18/20}$ elongase and/or a $C_{20/22}$ elongase. As such, the present invention encompasses a method of producing PUFAs comprising exposing a fatty acid substrate to the PUFA enzyme(s) described herein, such that the substrate is converted to the desired fatty acid product. Thus, each PUFA gene and corresponding enzyme product described herein (e.g., a wildtype, codon-optimized, synthetic and/or mutant enzyme having appropriate desaturase or elongase activity) can be used directly or indirectly for the production of PUFAs. Direct production of PUFAs occurs wherein the fatty acid substrate is converted directly into the desired fatty acid product without any intermediate steps or pathway intermediates. For example, production of AA would occur in a host cell which produces or which is provided DGLA, by adding or introducing into said cell an expression cassette that provides delta-5 desaturase activity. Similarly, expression of the delta-9 elongase of the invention permits the direct synthesis of EDA and ETrA (when provided LA and ALA, respectively, as substrate). Thus, for example, the present invention may encompass a method of producing either EDA or ETrA, respectively, comprising:
  a) providing a host organism including, but not limited to, an oleaginous yeast comprising: (i) a gene encoding a delta-9 elongase polypeptide as set forth in SEQ ID NO:5 or SEQ ID NO:127; and
    (ii) a source of elongase substrate consisting of either LA or ALA, respectively; and,
  b) growing the yeast of step (a) in the presence of a suitable fermentable carbon source wherein the gene encoding a delta-9 elongase polypeptide is expressed and LA is converted to EDA or ALA is converted to ETrA, respectively; and,
  c) optionally recovering the EDA or ETrA, respectively, of step (b).

In some preferred embodiments, the nucleotide sequence of a gene encoding a delta-9 elongase polypeptide is set forth in SEQ ID NO:90 wherein at least 106 codons have been optimized for expression in *Yarrowia*.

In contrast, multiple genes encoding the PUFA biosynthetic pathway may be used in combination, such that a series of reactions occur to produce a desired PUFA. For example, expression cassette(s) encoding delta-9 elongase, delta-8 desaturase, delta-5 desaturase and delta-1.7 desaturase activity would enable a host cell that naturally produces LA, to instead produce ARA (such that LA is converted to EDA by delta-9 elongase; EDA may then be converted to DGLA by a delta-8 desaturase; DGLA is then converted to ARA by a delta-5 desaturase). In a related manner, expression of the delta-9 elongase of the invention enables the indirection production of ETA, EPA, DPA and/or DHA as down-stream PUFAs, if subsequent desaturase and elongation reactions are catalyzed. In a preferred embodiment, wherein the host cell is an oleaginous yeast, expression cassettes encoding each of the enzymes necessary for PUFA biosynthesis will need to be introduced into the organism, since naturally produced PUFAs in these organisms are limited to 18:2 fatty acids (i.e., LA), and less commonly, 18:3 fatty acids (i.e., ALA). Alternatively, substrate feeding may be required.

Vectors or DNA cassettes useful for the transformation of suitable microbial host cells are well known in the art. The specific choice of sequences present in the construct is dependent upon the desired expression products (supra), the nature of the host cell and the proposed means of separating transformed cells versus non-transformed cells. Typically, however, the vector or cassette contains sequences directing transcription and translation of the relevant gene(s), a selectable marker and sequences allowing autonomous replication or chromosomal integration. Suitable vectors comprise a region 5' of the gene that controls transcriptional initiation (e.g., a promoter) and a region 3' of the DNA fragment that controls transcriptional termination (i.e., a terminator). It is most preferred when both control regions are derived from genes from the transformed host cell, although it is to be understood that such control regions need not be derived from the genes native to the specific species chosen as a production host.

Initiation control regions or promoters which are useful to drive expression of desaturase and/or elongase ORFs in the desired microbial host cell are numerous and familiar to those skilled in the art. Virtually any promoter capable of directing expression of these genes in the selected host cell is suitable for the present invention. Expression in a microbial host cell can be accomplished in a transient or stable fashion. Transient expression can be accomplished by inducing the activity of a regulatable promoter operably linked to the gene of interest, alternatively, stable expression can be achieved by the use of a constitutive promoter operably linked to the gene of interest. As an example, when the host cell is yeast, transcriptional and translational regions functional in yeast cells are provided, particularly from the host species. The transcriptional initiation regulatory regions can be obtained, for example, from (1) genes in the glycolytic pathway, such as alcohol dehydrogenase, glyceraldehyde-3-phosphate-dehydrogenase (WO 2005/003310), phosphoglycerate mutase (WO 2005/003310), fructose-bisphosphate aldolase (WO 2005/049805), phosphoglucose-isomerase, phosphoglycerate kinase, glycerol-3-phosphate O-acyltransferase (see U.S. patent application Ser. No. 11/225,354), etc.; or (2) regulatable genes such as acid phosphatase, lactase, metallothionein, glucoamylase, the translation elongation factor EF1-α (TEF)

protein (U.S. Pat. No. 6,265,185), ribosomal protein S7 (U.S. Pat. No. 6,265,185),), ammonium transporter proteins (U.S. patent application Ser. No. 11/185,301), export proteins, etc. Any one of a number of regulatory sequences can be used, depending upon whether constitutive or induced transcription is desired, the efficiency of the promoter in expressing the ORF of interest, the ease of construction and the like.

Nucleotide sequences surrounding the translational initiation codon 'ATG' have been found to affect expression in yeast cells. If the desired polypeptide is poorly expressed in yeast, the nucleotide sequences of exogenous genes can be modified to include an efficient yeast translation initiation sequence to obtain optimal gene expression. For expression in yeast, this can be done by site-directed mutagenesis of an inefficiently expressed gene by fusing it in-frame to an endogenous yeast gene, preferably a highly expressed gene. Alternatively, as demonstrated in the invention herein in *Yarrowia lipolytica*, one can determine the consensus translation initiation sequence in the host and engineer this sequence into heterologous genes for their optimal expression in the host of interest.

The termination region can be derived from the 3' region of the gene from which the initiation region was obtained or from a different gene. A large number of termination regions are known and function satisfactorily in a variety of hosts (when utilized both in the same and different genera and species from where they were derived). The termination region usually is selected more as a matter of convenience rather than because of any particular property. Preferably, the termination region is derived from a yeast gene, particularly *Saccharomyces, Schizosaccharomyces, Candida, Yarrowia* or *Kluyveromyces*. The 3'-regions of mammalian genes encoding γ-interferon and α-2 interferon are also known to function in yeast. Termination control regions may also be derived from various genes native to the preferred hosts. Optionally, a termination site may be unnecessary; however, it is most preferred if included.

As one of skill in the art is aware, merely inserting a gene into a cloning vector does not ensure that it will be successfully expressed at the level needed. In response to the need for a high expression rate, many specialized expression vectors have been created by manipulating a number of different genetic elements that control aspects of transcription, translation, protein stability, oxygen limitation and secretion from the host cell. More specifically, some of the molecular features that have been manipulated to control gene expression include: (1) the nature of the relevant transcriptional promoter and terminator sequences; (2) the number of copies of the cloned gene and whether the gene is plasmid-borne or integrated into the genome of the host cell; (3) the final cellular location of the synthesized foreign protein; (4) the efficiency of translation in the host organism; (5) the intrinsic stability of the cloned gene protein within the host cell; and (6) the codon usage within the cloned gene, such that its frequency approaches the frequency of preferred codon usage of the host cell. Each of these types of modifications are encompassed in the present invention, as means to further optimize expression of the PUFA biosynthetic pathway enzymes.

Once the DNA encoding a desaturase or elongase polypeptide suitable for expression in an oleaginous yeast has been obtained, it is placed in a plasmid vector capable of autonomous replication in a host cell; or, it is directly integrated into the genome of the host cell. Integration of expression cassettes can occur randomly within the host genome or can be targeted through the use of constructs containing regions of homology with the host genome sufficient to target recombination within the host locus. Where constructs are targeted to an endogenous locus, all or some of the transcriptional and translational regulatory regions can be provided by the endogenous locus.

A method of expressing genes in *Yarrowia lipolytica* is by integration of linear DNA into the genome of the host; and, integration into multiple locations within the genome can be particularly useful when high level expression of genes are desired. Toward this end, it is desirable to identify a sequence within the genome that is present in multiple copies.

Schmid-Berger et al. (*J. Bact.* 176(9):2477-2482 (1994)) discovered the first retrotransposon-like element Ylt1 in *Yarrowia lipolytica*; This retrotransposon is characterized by the presence of long terminal repeats (LTRs; each approximately 700 bp in length) called zeta regions. Ylt1 and solo zeta elements were present in a dispersed manner within the genome in at least 35 copies/genome and 50-60 copies/genome, respectively; both elements were determined to function as sites of homologous recombination. Further, work by Juretzek et al. (*Yeast* 18:97-113 (2001)) demonstrated that gene expression could be dramatically increased by targeting plasmids into the repetitive regions of the yeast genome (using linear DNA with LTR zeta regions at both ends), as compared to the expression obtained using low-copy plasmid transformants. Thus, zeta-directed integration can be ideal as a means to ensure multiple integration of plasmid DNA into *Yarrowia lipolytica*, thereby permitting high-level gene expression. Unfortunately, however, not all strains of *Yarrowia lipolytica* possess zeta regions (e.g., the strain identified as ATCC Accession No. #20362). When the strain lacks such regions, it is also possible to integrate plasmid DNA comprising expression cassettes into alternate loci to reach the desired copy number for the expression cassette. For example, preferred alternate loci include: the Ura3 locus (GenBank Accession No. AJ306421), the Leu2 gene locus (GenBank Accession No. AF260230), the Lys5 gene (GenBank Accession No. M34929), the Aco2 gene locus (GenBank Accession No. AJ001300), the Pox3 gene locus (Pox3: GenBank Accession No. XP_503244; or, Aco3: GenBank Accession No. AJ001301), the delta-12 desaturase gene locus, the Lip1 gene locus (GenBank Accession No. Z50020) and/or the Lip2 gene locus (GenBank Accession No. AJ012632).

Advantageously, the Ura3 gene can be used repeatedly in combination with 5-fluoroorotic acid (5-fluorouracil-6-carboxylic acid monohydrate; "5-FOA") selection (infra), to readily permit genetic modifications to be integrated into the *Yarrowia* genome in a facile manner.

Where two or more genes are expressed from separate replicating vectors, it is desirable that each vector has a different means of selection and should lack homology to the other constructs to maintain stable expression and prevent reassortment of elements among constructs. Judicious choice of regulatory regions, selection means and method of propagation of the introduced construct can be experimentally determined so that all introduced genes are expressed at the necessary levels to provide for synthesis of the desired products.

Constructs comprising the gene of interest may be introduced into a host cell by any standard technique. These techniques include transformation (e.g., lithium acetate transformation [*Methods in Enzymology*, 194:186-187 (1991)]), protoplast fusion, bolistic impact, electroporation, microinjection, or any other method that introduces the gene of interest into the host cell. More specific teachings applicable for oleaginous yeasts (i.e., *Yarrowia lipolytica*) include U.S. Pat. Nos. 4,880,741 and 5,071,764 and Chen, D. C. et al. (*Appl Microbiol Biotechnol.* 48(2):232-235 (1997)).

For convenience, a host cell that has been manipulated by any method to take up a DNA sequence (e.g., an expression cassette) will be referred to as "transformed" or "recombinant" herein. The transformed host will have at least one copy of the expression construct and may have two or more, depending upon whether the gene is integrated into the genome, amplified or is present on an extrachromosomal element having multiple copy numbers.

The transformed host cell can be identified by various selection techniques, as described in WO 04/101757. Preferred selection methods for use herein are resistance to kanamycin, hygromycin and the amino glycoside G418, as well as ability to grow on media lacking uracil, leucine, lysine, tryptophan or histidine. In alternate embodiments, 5-FOA is used for selection of yeast Ura-mutants. The compound is toxic to yeast cells that possess a functioning URA3 gene encoding orotidine 5'-monophosphate decarboxylase (OMP decarboxylase); thus, based on this toxicity, 5-FOA is especially useful for the selection and identification of Ura⁻ mutant yeast strains (Bartel, P. L. and Fields, S., Yeast 2-Hybrid System, Oxford University: New York, v. 7, pp 109-147, 1997). More specifically, one can first knockout the native Ura3 gene to produce a strain having a Ura– phenotype, wherein selection occurs based on 5-FOA resistance. Then, a cluster of multiple chimeric genes and a new Ura3 gene could be integrated into a different locus of the *Yarrowia* genome to thereby produce a new strain having a Ura+ phenotype. Subsequent integration would produce a new Ura3– strain (again identified using 5-FOA selection), when the introduced Ura3 gene is knocked out. Thus, the Ura3 gene (in combination with 5-FOA selection) can be used as a selection marker in multiple rounds of transformation.

Following transformation, substrates suitable for the recombinantly expressed desaturases and/or elongases (and optionally other PUFA enzymes that are expressed within the host cell) may be produced by the host either naturally or transgenically, or they may be provided exogenously.

Methods for manipulating biochemical pathways are well known to those skilled in the art; and, it is expected that numerous manipulations will be possible to maximize omega-3 and/or omega-6 fatty acid biosynthesis in oleaginous yeasts, and particularly, in *Yarrowia lipolytica*. This may require metabolic engineering directly within the PUFA biosynthetic pathway or additional manipulation of pathways that contribute carbon to the PUFA biosynthetic pathway.

In the case of manipulations within the PUFA biosynthetic pathway, it may be desirable to increase the production of LA to enable increased production of omega-6 and/or omega-3 fatty acids. Introducing and/or amplifying genes encoding delta-9 and/or delta-12 desaturases may accomplish this.

To maximize production of omega-6 unsaturated fatty acids, it is well known to one skilled in the art that production is favored in a host microorganism that is substantially free of ALA. Thus, preferably, the host is selected or obtained by removing or inhibiting delta-15 or omega-3 type desaturase activity that permits conversion of LA to ALA. The endogenous desaturase activity can be reduced or eliminated by, for example, (1) providing a cassette for transcription of anti-sense sequences to the delta-15 desaturase transcription product, (2) disrupting the delta-15 desaturase gene through insertion, substitution and/or deletion of all or part of the target gene; or (3) using a host cell which naturally has [or has been mutated to have] low or no delta-15 desaturase activity. Inhibition of undesired desaturase pathways can also be accomplished through the use of specific desaturase inhibitors such as those described in U.S. Pat. No. 4,778,630.

Alternatively, it may be desirable to maximize production of omega-3 fatty acids (and minimize synthesis of omega-6 fatty acids). Thus, one could utilize a host microorganism wherein the delta-12 desaturase activity that permits conversion of oleic acid to LA is removed or inhibited, using any of the means described above (see also e.g., WO 2004/104167, herein incorporated entirely by reference). Subsequently, appropriate expression cassettes would be introduced into the host, along with appropriate substrates (e.g., ALA) for conversion to omega-3 fatty acid derivatives of ALA (e.g., STA, ETrA, ETA, EPA, DPA, DHA).

Beyond the immediate PUFA biosynthetic pathway, it is expected that manipulation of several other enzymatic pathways leading to the biosynthesis of precursor fatty acids may contribute to the overall net biosynthesis of specific PUFAs. Identification and manipulation of these related pathways will be useful in the future.

Additional copies of desaturase and elongase genes may be introduced into the host to increase the output of omega-3 and/or omega-6 fatty acid biosynthetic pathways. Expression of the desaturase or elongase genes also can be increased at the transcriptional level through the use of a stronger promoter (either regulated or constitutive) to cause increased expression, by removing/deleting destabilizing sequences from either the mRNA or the encoded protein, or by adding stabilizing sequences to the mRNA (U.S. Pat. No. 4,910,141). Yet another approach to increase expression of the desaturase or elongase genes, as demonstrated in the instant invention, is to increase the translational efficiency of the encoded mRNAs by replacement of codons in the native gene with those for optimal gene expression in the selected host microorganism.

Conversely, biochemical pathways competing with the omega-3 and/or omega-6 fatty acid biosynthetic pathways for energy or carbon, or native PUFA biosynthetic pathway enzymes that interfere with production of a particular PUFA end-product, may be eliminated by gene disruption or down-regulated by other means (e.g., antisense mRNA). For gene disruption, a foreign DNA fragment (typically a selectable marker gene) is inserted into the structural gene to be disrupted in order to interrupt its coding sequence and thereby functionally inactivate the gene. Transformation of the disruption cassette into the host cell results in replacement of the functional native gene by homologous recombination with the non-functional disrupted gene (see, for example: Hamilton et al. *J. Bacteriol.* 171:4617-4622 (1989); Balbas et al. *Gene* 136:211-213 (1993); Gueldener et al. *Nucleic Acids Res.* 24:2519-2524 (1996); and Smith et al. *Methods Mol. Cell. Biol.* 5:270-277 (1996)).

Antisense technology is another method of down-regulating genes when the sequence of the target gene is known. To accomplish this, a nucleic acid segment from the desired gene is cloned and operably linked to a promoter such that the anti-sense strand of RNA will be transcribed. This construct is then introduced into the host cell and the antisense strand of RNA is produced. Antisense RNA inhibits gene expression by preventing the accumulation of mRNA that encodes the protein of interest. The person skilled in the art will know that special considerations are associated with the use of antisense technologies in order to reduce expression of particular genes. For example, the proper level of expression of antisense genes may require the use of different chimeric genes utilizing different regulatory elements known to the skilled artisan.

Although targeted gene disruption and antisense technology offer effective means of down-regulating genes where the sequence is known, other less specific methodologies have been developed that are not sequence-based (e.g., mutagenesis via UV radiation/chemical agents or use of transposable elements/transposons; see WO 2004/101757).

Within the context of the present invention, it may be useful to modulate the expression of the fatty acid biosynthetic pathway by any one of the methods described above. For example, the present invention provides methods whereby genes encoding key enzymes in the biosynthetic pathways are introduced into oleaginous yeasts for the production of omega-3 and/or omega-6 fatty acids. It will be particularly useful to express these genes in oleaginous yeasts that do not naturally possess omega-3 and/or omega-6 fatty acid biosynthetic pathways and coordinate the expression of these genes, to maximize production of preferred PUFA products using various means for metabolic engineering of the host organism.

Microbial host cells for production of omega fatty acids may include microbial hosts that grow on a variety of feedstocks, including simple or complex carbohydrates, organic acids and alcohols, and/or hydrocarbons over a wide range of temperature and pH values.

Preferred microbial hosts, however, are oleaginous yeasts. These organisms are naturally capable of oil synthesis and accumulation, wherein the oil can comprise greater than about 25% of the cellular dry weight, more preferably greater than about 30% of the cellular dry weight, and most preferably greater than about 40% of the cellular dry weight. Genera typically identified as oleaginous yeast include, but are not limited to: *Yarrowia, Candida, Rhodotorula, Rhodosporidium, Cryptococcus, Trichosporon* and *Lipomyces*. More specifically, illustrative oil-synthesizing yeasts include: *Rhodosporidium toruloides, Lipomyces starkeyii, L. lipoferus, Candida revkaufi, C. pulcherrima, C. tropicalis, C. utilis, Trichosporon pullans, T. cutaneum, Rhodotorula glutinus, R. graminis* and *Yarrowia lipolytica* (formerly classified as *Candida lipolytica*).

Most preferred is the oleaginous yeast *Yarrowia lipolytica*; and, in a further embodiment, most preferred are the *Yarrowia lipolytica* strains designated as ATCC Accession Nos. #20362, ATCC #8862, ATCC #18944, ATCC #76982 and/or LGAM S(7) 1 (Papanikolaou S., and Aggelis G., *Bioresour. Technol.* 82(1):43-9 (2002)).

The transformed microbial host cell is grown under conditions that optimize desaturase and elongase activities and produce the greatest and the most economical yield of the preferred PUFAs. In general, media conditions that may be optimized include the type and amount of carbon source, the type and amount of nitrogen source, the carbon-to-nitrogen ratio, the oxygen level, growth temperature, pH, length of the biomass production phase, length of the oil accumulation phase and the time of cell harvest. Microorganisms of interest, such as oleaginous yeast, are grown in complex-media (e.g., yeast extract-peptone-dextrose broth (YPD)) or a defined minimal media that lacks a component necessary for growth and thereby forces selection of the desired expression cassettes (e.g., yeast nitrogen base (Difco Laboratories, Detroit, Mich.)).

Fermentation media in the present invention must contain a suitable carbon source. Suitable carbon sources may include, but are not limited to: monosaccharides (e.g., glucose, fructose), disaccharides (e.g., lactose, sucrose), oligosaccharides, polysaccharides (e.g., starch, cellulose or mixtures thereof), sugar alcohols (e.g., glycerol) or mixtures from renewable feedstocks (e.g., cheese whey permeate, cornsteep liquor, sugar beet molasses, barley malt). Additionally, carbon sources may include alkanes, fatty acids, esters of fatty acids, monoglycerides, diglycerides, triglycerides, phospholipids and various commercial sources of fatty acids including vegetable oils (e.g., soybean oil) and animal fats. Additionally, the carbon source may include one-carbon sources (e.g., carbon dioxide, methanol, formaldehyde, formate and carbon-containing amines) for which metabolic conversion into key biochemical intermediates has been demonstrated. Hence it is contemplated that the source of carbon utilized in the present invention may encompass a wide variety of carbon-containing sources and will only be limited by the choice of the host organism. Although all of the above mentioned carbon sources and mixtures thereof are expected to be suitable in the present invention, preferred carbon sources are sugars and/or fatty acids. Most preferred is glucose and/or fatty acids containing between 10-22 carbons.

Nitrogen may be supplied from an inorganic (e.g., $(NH_4)_2SO_4$) or organic (e.g., urea or glutamate) source. In addition to appropriate carbon and nitrogen sources, the fermentation media must also contain suitable minerals, salts, cofactors, buffers, vitamins and other components known to those skilled in the art suitable for the growth of the microorganism and promotion of the enzymatic pathways necessary for PUFA production. Particular attention is given to several metal ions (e.g., $Mn^{+2}$, $Co^{+2}$, $Zn^{+2}$, $Mg^{+2}$) that promote synthesis of lipids and PUFAs (Nakahara, T. et al., *Ind. Appl. Single Cell Oils*, D. J. Kyle and R. Colin, eds. pp 61-97 (1992)).

Preferred growth media in the present invention are common commercially prepared media, such as yeast nitrogen base (Difco Laboratories, Detroit, Mich.). Other defined or synthetic growth media may also be used and the appropriate medium for growth of the particular microorganism will be known by one skilled in the art of microbiology or fermentation science. A suitable pH range for the fermentation is typically between about pH 4.0 to pH 8.0, wherein pH 5.5 to pH 7.0 is preferred as the range for the initial growth conditions. The fermentation may be conducted under aerobic or anaerobic conditions, wherein microaerobic conditions are preferred.

Typically, accumulation of high levels of PUFAs in oleaginous yeast cells requires a two-stage process, since the metabolic state must be "balanced" between growth and synthesis/storage of fats. Thus, most preferably, a two-stage fermentation process is necessary for the production of PUFAs in oleaginous yeast. This approach is described in WO 2004/101757, as are various suitable fermentation process designs (i.e., batch, fed-batch and continuous) and considerations during growth.

The PUFAs may be found in the host microorganism as free fatty acids or in esterified forms such as acylglycerols, phospholipids, sulfolipids or glycolipids, and may be extracted from the host cell through a variety of means well-known in the art. One review of extraction techniques, quality analysis and acceptability standards for yeast lipids is that of Z. Jacobs (*Critical Reviews in Biotechnology* 12(5/6):463-491 (1992)). A brief review of downstream processing is also available by A. Singh and O. Ward (*Adv. Appl. Microbiol.* 45:271-312 (1997)).

In general, means for the purification of PUFAs may include extraction with organic solvents, sonication, supercritical fluid extraction (e.g., using carbon dioxide), saponification and physical means such as presses, or combinations thereof. One is referred to the teachings of WO 2004/101757 for additional details.

The market place currently supports a large variety of food and feed products, incorporating omega-3 and/or omega-6 fatty acids (particularly ARA, EPA and DHA). It is contemplated that the plant oils of the invention and the yeast oils of the invention comprising long-chain PUFAs will function in food and feed products to impart the health benefits of current formulations. More specifically, oils of the invention containing omega-3 and/or omega-6 fatty acids will be suitable for use in a variety of food and feed products including, but not limited to food analogs, meat products, cereal products, baked foods, snack foods and dairy products.

Additionally the present oils may be used in formulations to impart health benefit in medical foods including medical nutritionals, dietary supplements, infant formula as well as pharmaceutical products. One of skill in the art of food processing and food formulation will understand how the amount and composition of the present oils may be added to the food or feed product. Such an amount will be referred to herein as an "effective" amount and will depend on the food or feed product, the diet that the product is intended to supplement or the medical condition that the medical food or medical nutritional is intended to correct or treat.

A "food analog" is a food-like product manufactured to resemble its food counterpart, whether meat, cheese, milk or the like, and is intended to have the appearance, taste, and texture of its counterpart. Thus, the term "food" as used herein also encompasses food analogs. Food analogs can be made use processes well known to those skilled in the art. U.S. Pat. Nos. 6,355,296 B1 and 6,187,367 B1 describe emulsified meat analogs and emulsified meat extenders. U.S. Pat. No. 5,206,050 B1 describes soy protein curd useful for cooked food analogs (also can be used as a process to form a curd useful to make food analogs). U.S. Pat. No. 4,284,656 to Hwa describes a soy protein curd useful for food analogs. U.S. Pat. No. 3,988,485 to Hibbert et al. describes a meat-like protein food formed from spun vegetable protein fibers. U.S. Pat. No. 3,950,564 to Puski et al. describes a process of making a soy based meat substitute and U.S. Pat. No. 3,925,566 to Reinhart et al. describes a simulated meat product. For example, soy protein that has been processed to impart a structure, chunk or fiber for use as a food ingredient is called "textured soy protein" (TSP). TSPs are frequently made to resemble meat, seafood, or poultry in structure and appearance when hydrated.

Food analogs can be classified as imitation or substitutes depending on their functional and compositional characteristics. For example, an imitation cheese need only resemble the cheese it is designed to replace. However, a product can generally be called a substitute cheese only if it is nutritionally equivalent to the cheese it is replacing and meets the minimum compositional requirements for that cheese. Thus, substitute cheese will often have higher protein levels than imitation cheeses and be fortified with vitamins and minerals.

Milk analogs or nondairy food products include, but are not limited to, imitation milks and nondairy frozen desserts (e.g., those made from soybeans and/or soy protein products).

Meat products encompass a broad variety of products. In the United States "meat" includes "red meats" produced from cattle, hogs and sheep. In addition to the red meats there are poultry items which include chickens, turkeys, geese, guineas, ducks and the fish and shellfish. There is a wide assortment of seasoned and processed meat products: fresh, cured and fried, and cured and cooked. Sausages and hot dogs are examples of processed meat products. Thus, the term "meat products" as used herein includes, but is not limited to, processed meat products.

A cereal food product is a food product derived from the processing of a cereal grain. A cereal grain includes any plant from the grass family that yields an edible grain (seed). The most popular grains are barley, corn, millet, oats, quinoa, rice, rye, sorghum, triticale, wheat and wild rice. Examples of a cereal food product include, but are not limited to: whole grain, crushed grain, grits, flour, bran, germ, breakfast cereals, extruded foods, pastas, and the like.

A baked goods product comprises any of the cereal food products mentioned above and has been baked or processed in a manner comparable to baking (i.e., to dry or harden by subjecting to heat). Examples of a baked good product include, but are not limited to: bread, cakes, doughnuts, bars, pastas, bread crumbs, baked snacks, mini-biscuits, mini-crackers, mini-cookies, and mini-pretzels. As was mentioned above, oils of the invention can be used as an ingredient.

A snack food product comprises any of the above or below described food products.

A fried food product comprises any of the above or below described food products that has been fried.

The beverage can be in a liquid or in a dry powdered form.

For example, there can be mentioned non-carbonated drinks such as fruit juices, fresh, frozen, canned or concentrate; flavored or plain milk drinks, etc. Adult and infant nutritional formulas are well known in the art and commercially available (e.g., Similac®, Ensure®, Jevity®, and Alimentum® from Ross Products Division, Abbott Laboratories).

Infant formulas are liquids or reconstituted powders fed to infants and young children. "Infant formula" is defined herein as an enteral nutritional product which can be substituted for human breast milk in feeding infants and typically is composed of a desired percentage of fat mixed with desired percentages of carbohydrates and proteins in an aqueous solution (e.g., see U.S. Pat. No. 4,670,285). Based on the worldwide composition studies, as well as levels specified by expert groups, average human breast milk typically contains about 0.20% to 0.40% of total fatty acids (assuming about 50% of calories from fat); and, generally the ratio of DHA to ARA would range from about 1:1 to 1:2 (see, e.g., formulations of Enfamil LIPIL™ (Mead Johnson & Company) and Similac Advance™ (Ross Products Division, Abbott Laboratories)). Infant formulas have a special role to play in the diets of infants because they are often the only source of nutrients for infants; and, although breast-feeding is still the best nourishment for infants, infant formula is a close enough second that babies not only survive but thrive.

A dairy product is a product derived from milk. A milk analog or nondairy product is derived from a source other than milk, for example, soymilk as was discussed above. These products include, but are not limited to: whole milk, skim milk, fermented milk products such as yogurt or sour milk, cream, butter, condensed milk, dehydrated milk, coffee whitener, coffee creamer, ice cream, cheese, etc.

Additional food products into which the long-chain PUFA-containing oils of the invention could be included are, for example, chewing gums, confections and frostings, gelatins and puddings, hard and soft candies, jams and jellies, white granulated sugar, sugar substitutes, sweet sauces, toppings and syrups, and dry-blended powder mixes.

A health food product is any food product that imparts a health benefit and include functional foods, medical foods, medical nutritionals and dietary supplements. Additionally, the oils of the invention may be used in standard pharmaceutical compositions (e.g., the long-chain PUFA containing oils could readily be incorporated into the any of the above mentioned food products, to thereby produce a functional or medical food). For example, more concentrated formulations comprising ARA, EPA or DHA include capsules, powders, tablets, softgels, gelcaps, liquid concentrates and emulsions which can be used as a dietary supplement in humans or animals other than humans.

Animal feeds are generically defined herein as products intended for use as feed or for mixing in feed for animals other than humans. The long-chain PUFA containing oils of the invention can be used as an ingredient in various animal feeds.

More specifically, although not limited therein, it is expected that the oils of the invention can be used within pet food products, ruminant and poultry food products and aquacultural food products. Pet food products are those products intended to be fed to a pet (e.g., dog, cat, bird, reptile, rodent). These products can include the cereal and health food products above, as well as meat and meat byproducts, soy protein products, grass and hay products (e.g., alfalfa, timothy, oat or brome grass, vegetables). Ruminant and poultry food products are those wherein the product is intended to be fed to an animal (e.g., turkeys, chickens, cattle, swine). As with the pet foods above, these products can include cereal and health food products, soy protein products, meat and meat byproducts, and grass and hay products as listed above. Aquacultural food products (or "aquafeeds") are those products intended to be used in aquafarming which concerns the propagation, cultivation or farming of aquatic organisms and/or animals in fresh or marine waters.

EXAMPLES

The present invention is further defined in the following Examples, in which parts and percentages are by weight and degrees are Celsius, unless otherwise stated. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions. Thus, various modifications of the invention in addition to those shown and described herein will be apparent to those skilled in the art from the foregoing description. Such modifications are also intended to fall within the scope of the appended claims.

The meaning of abbreviations is as follows: "sec" means second(s), "min" means minute(s), "h" means hour(s), "d" means day(s), "μl" means microliter(s), "mL" means milliliter(s), "L" means liter(s), "μM" means micromolar, "mM" means millimolar, "M" means molar, "mmol" means millimole(s), "μmole" mean micromole(s), "g" means gram(s), "μg" means microgram(s), "ng" means nanogram(s), "U" means unit(s), "bp" means base pair(s) and "kB" means kilobase(s).

Transformation and Cultivation of *Yarrowia lipolytica*

*Yarrowia lipolytica* strains with ATCC Accession Nos. #20362, #76982 and #90812 were purchased from the American Type Culture Collection (Rockville, Md.). *Yarrowia lipolytica* strains were typically grown at 28° C. on YPD agar (1% yeast extract, 2% bactopeptone, 2% glucose, 2% agar).

Transformation of *Yarrowia lipolytica* was performed according to the method of Chen, D. C. et al. (*Appl. Microbiol. Biotechnol.* 48(2):232-235 (1997)), unless otherwise noted. Briefly, *Yarrowia* was streaked onto a YPD plate and grown at 30° C. for approximately 18 h. Several large loopfuls of cells were scraped from the plate and resuspended in 1 mL of transformation buffer containing: 2.25 mL of 50% PEG, average MW 3350; 0.125 mL of 2 M Li acetate, pH 6.0; 0.125 mL of 2 M DTT; and 50 μg sheared salmon sperm DNA. Then, approximately 500 ng of linearized plasmid DNA was incubated in 100 μL of resuspended cells, and maintained at 39° C. for 1 h with vortex mixing at 15 min intervals. The cells were plated onto selection media plates and maintained at 30° C. for 2 to 3 days.

For selection of transformants, minimal medium ("MM") was generally used; the composition of MM is as follows: 0.17% yeast nitrogen base (Difco Laboratories, Detroit, Mich.) without ammonium sulfate or amino acids, 2% glucose, 0.1% proline, pH 6.1). Supplements of uracil were added as appropriate to a final concentration of 0.01% (thereby producing "MMU" selection media, prepared with 20 g/L agar).

Alternatively, transformants were selected on 5-fluoroorotic acid ("FOA"; also 5-fluorouracil-6-carboxylic acid monohydrate) selection media, comprising: 0.17% yeast nitrogen base (Difco Laboratories, Detroit, Mich.) without ammonium sulfate or amino acids, 2% glucose, 0.1% proline, 75 mg/L uracil, 75 mg/L uridine, 900 mg/L FOA (Zymo Research Corp., Orange, Calif.) and 20 g/L agar.

Fatty Acid Analysis of *Yarrowia lipolytica*

For fatty acid analysis, cells were collected by centrifugation and lipids were extracted as described in Bligh, E. G. & Dyer, W. J. (*Can. J. Biochem. Physiol.* 37:911-917 (1959)). Fatty acid methyl esters were prepared by transesterification of the lipid extract with sodium methoxide (Roughan, G., and Nishida I. *Arch Biochem Biophys.* 276(1):3846 (1990)) and subsequently analyzed with a Hewlett-Packard 6890 GC fitted with a 30 m×0.25 mm (i.d.) HP-INNOWAX (Hewlett-Packard) column. The oven temperature was from 170° C. (25 min hold) to 185° C. at 3.5° C./min.

For direct base transesterification, *Yarrowia* culture (3 mL) was harvested, washed once in distilled water, and dried under vacuum in a Speed-Vac for 5-10 min. Sodium methoxide (100 μL of 1%) was added to the sample, and then the sample was vortexed and rocked for 20 min. After adding 3 drops of 1 M NaCl and 400 μL hexane, the sample was vortexed and spun. The upper layer was removed and analyzed by GC as described above.

Example 1

*Euglena gracilis* Growth Conditions, Lipid Profile and mRNA Isolation

*Euglena gracilis* was obtained from Dr. Richard Triemer's lab at Michigan State University (East Lansing, Mich.). From 10 mL of actively growing culture, a 1 mL aliquot was transferred into 250 mL of *Euglena gracilis* (Eg) Medium in a 500 mL glass bottle. Eg medium was made by combining 1 g of sodium acetate, 1 g of beef extract (U126-01, Difco Laboratories, Detroit, Mich.), 2 g of Bacto® tryptone (0123-17-3, Difco Laboratories), 2 g of Bacto® yeast extract (0127-17-9, Difco Laboratories) in 970 mL of water. After filter sterilizing, 30 mL of soil-water supernatant (15-3790, Carolina Biological Supply Company, Burlington, N.C.) was aseptically-added to give the final Eg medium. *Euglena gracilis* cultures were grown at 23° C. with a 16 h light, 8 h dark cycle for 2 weeks with no agitation.

Figure 13:
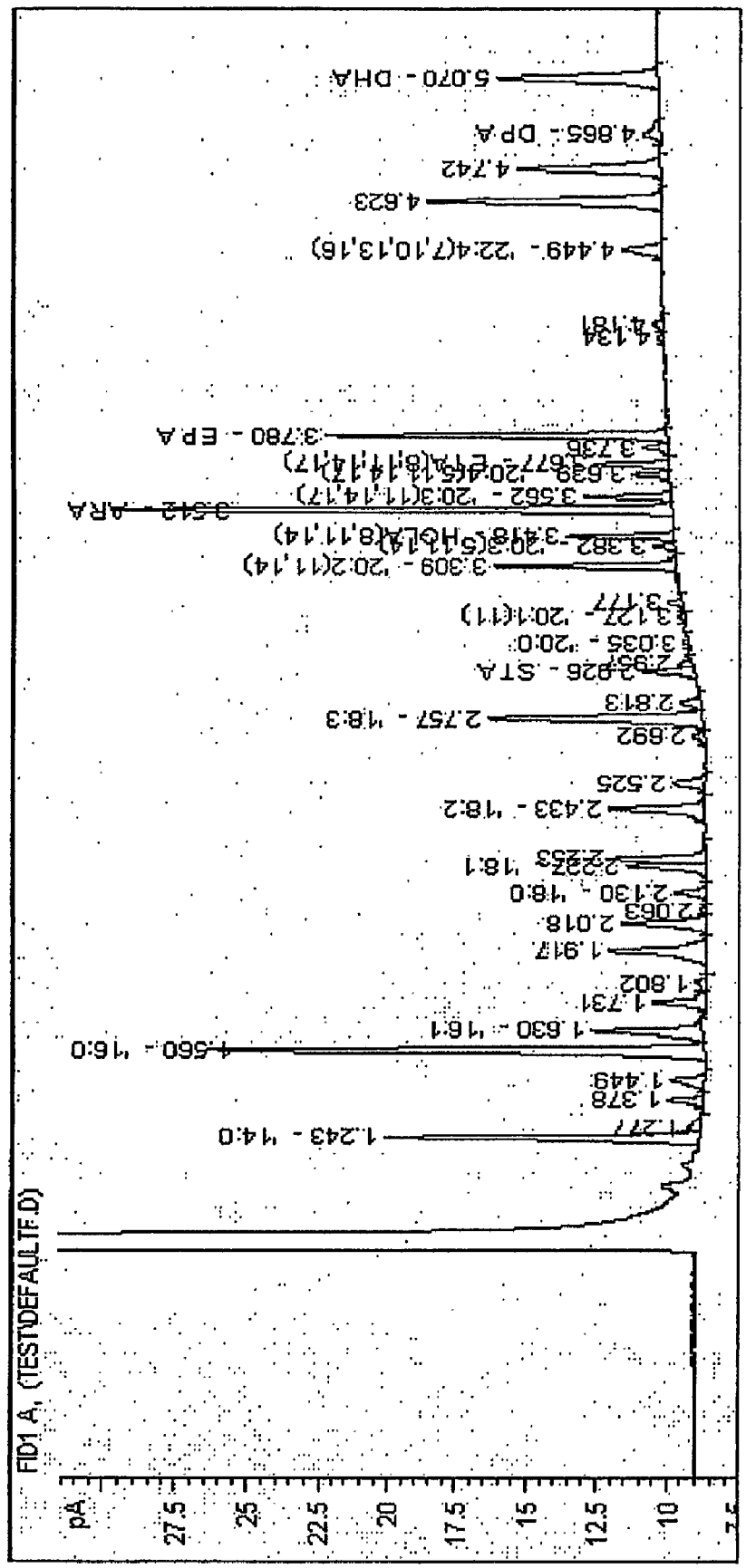
FIG. 13 shows a chromatogram of the lipid profile of an *Euglena gracilis* cell extract as described in the Examples.

After 2 weeks, 10 mL of culture was removed for lipid analysis and centrifuged at 1,800×g for 5 min. The pellet was washed once with water and re-centrifuged. The resulting pellet was dried for 5 min under vacuum, resuspended in 100 μL of trimethylsulfonium hydroxide (TMSH) and incubated at room temperature for 15 min with shaking. After this, 0.5 mL of hexane was added and the vials were incubated for 15 min at room temperature with shaking. Fatty acid methyl esters (5 μL injected from hexane layer) were separated and quantified using a Hewlett-Packard 6890 Gas Chromatograph fitted with an Omegawax 320 fused silica capillary column (Supelco Inc., Cat. No. 24152). The oven temperature was programmed to hold at 220° C. for 2.7 min, increase to 240° C. at 20° C./min and then hold for an additional 2.3 min. Carrier gas was supplied by a Whatman hydrogen generator. Retention times were compared to those for methyl esters of standards commercially available (Nu-Chek Prep, Inc. Cat. No. U-99-A) and the resulting chromatogram is shown in FIG. 13.

The remaining 2 week culture (240 mL) was pelleted by centrifugation at 1,800×g for 10 min, washed once with water and re-centrifuged. Total RNA was extracted from the resulting pellet using the RNA STAT60™ reagent (TEL-TEST, Inc., Friendswood, Tex.) and following the manufacturer's protocol provided (use 5 mL of reagent, dissolved RNA in 0.5 mL of water). In this way, 1 mg of total RNA (2 mg/mL) was obtained from the pellet. The mRNA was isolated from 1 mg of total RNA using the mRNA Purification Kit (Amersham Biosciences, Piscataway, N.J.) following the manufacturer's protocol provided. In this way, 85 µg of mRNA was obtained.

Example 2

*Euglena gracilis* cDNA Synthesis, Library Construction and Sequencing

A cDNA library was generated using the Cloneminer™ cDNA Library Construction Kit (Cat. No. 18249-029, Invitrogen Corporation, Carlsbad, Calif.) and following the manufacturer's protocol provided (Version B, 25-0608). Using the non-radiolabeling method, cDNA was synthesized from 3.2 µg of mRNA (described above) using the Biotin-attB2-Oligo (dT) primer. After synthesis of the first and second strand, the attB1 adapter was added, ligated and the cDNA was size fractionated using column chromatography. DNA from fractions 7 and 8 (size ranging from ~800-1500 bp) were concentrated, recombined into pDONR™222 and transformed into *E. coli* ElectroMAX™ DH10B™ T1 Phage-Resistant cells (Invitrogen Corporation). The *Euglena gracilis* library was named eeg1c.

For sequencing, clones first were recovered from archived glycerol cultures grown/frozen in 384-well freezing media plates, and replicated with a sterile 384 pin replicator (Genetix, Boston, Mass.) in 384-well microtiter plates containing LB+75 µg/mL Kanamycin (replicated plates). Plasmids then were isolated, using the Templiphi DNA sequencing template amplification kit method (Amersham Biosciences) following the manufacturer's protocol. Briefly, the Templiphi method uses bacteriophage φ29 DNA polymerase to amplify circular single-stranded or double-stranded DNA by isothermal rolling circle amplification (Dean et al., *Genome Res.* 11:1095-1099 (2001); Nelson et al., *Biotechniques* 32:S44-S47 (2002)). After growing 20 h at 37° C., cells from the replicated plate were added to 5 µL of dilution buffer and denatured at 95° C. for 3 min to partially lyse cells and release the denatured template. 5 µL of Templiphi premix then were added to each sample and the resulting reaction mixture was incubated at 30° C. for 16 h, then at 65° C. for 10 min to inactivate the φ29 DNA polymerase activity. DNA quantification with the PicoGreen® dsDNA Quantitation Reagent (Molecular Probes) was performed after diluting the amplified samples 1:3 in distilled water.

The amplified products then were denatured at 95° C. for 10 min and end-sequenced in 384-well plates, using the M13F universal primer (SEQ ID NO:28), and the ABI Big-Dye version 3.1 Prism Sequencing Kit. For the sequencing reaction, 100-200 ng of templates and 6.4 pmol of primers were used, and the following reaction conditions were repeated 25 times: 96° C. for 10 sec, 50° C. for 5 sec and 60° C. for 4 min. After ethanol-based cleanup, cycle sequencing reaction products were resolved and detected on Perkin-Elmer ABI 3730xl automated sequencers.

Example 3

Identification of Long-Chain Polyunsaturated Fatty Acid Elongation Enzyme Homologs from *Euglena gracilis* cDNA Library eeg1c cDNA clones encoding long-chain polyunsaturated fatty acid elongation enzyme homologs (LC-PUFA ELO homologs or delta-9 elongases) were identified by conducting BLAST (Basic Local Alignment Search Tool; Altschul et al., *J. Mol. Biol.* 215:403-410 (1993)) searches for similarity to sequences contained in the BLAST "nr" database (comprising all non-redundant GenBank CDS translations, sequences derived from the 3-dimensional structure Brookhaven Protein Data Bank, the last major release of the SWISS-PROT protein sequence database, EMBL, and DDBJ databases). The cDNA sequences obtained in Example 2 were analyzed for similarity to all publicly available DNA sequences contained in the "nr" database using the BLASTN algorithm provided by the National Center for Biotechnology Information (NCBI). The DNA sequences were translated in all reading frames and compared for similarity to all publicly available protein sequences contained in the "nr" database using the BLASTX algorithm (Gish and States, *Nat. Genet.* 3:266-272 (1993)) provided by the NCBI. For convenience, the P-value (probability) of observing a match of a cDNA sequence to a sequence contained in the searched databases merely by chance as calculated by BLAST are reported herein as "pLog" values, which represent the negative of the logarithm of the reported P-value. Accordingly, the greater the pLog value, the greater the likelihood that the cDNA sequence and the BLAST "hit" represent homologous proteins.

The BLASTX search using the nucleotide sequences from clone eeg1c.pk001.n5.f revealed similarity of the protein encoded by the cDNA to the long-chain PUFA elongation enzyme from *Isochrysis galbana* (SEQ ID NO:27) (NCBI Accession No. AAL37626 (GI 17226123), locus AAL37626, CDS AF390174; Qi et al., *FEBS Lett.* 510(3):159-165 (2002)). The sequence of a portion of the cDNA insert from clone eeg1c.pk001.n5.f is shown in SEQ ID NO:1 (5' end of cDNA insert). Additional sequence was obtained from the 3' end of the cDNA insert of eeg1c.pk001.n5.1 as described above, but using the poly(A) tail-primed WobbleT oligonucleotides. Briefly, the WobbleT primer is an equimolar mix of 21mer poly(T)A, poly(T)C, and poly(T)G, used to sequence the 3' end of cDNA clones.

The 3' end sequence is shown in SEQ ID NO:2. Both the 5' and 3' sequences were aligned using Sequencher™ (Version 4.2, Gene Codes Corporation, Ann Arbor, Mich.) and the resulting sequence for the cDNA is shown in SEQ ID NO:3. Sequence for the coding sequence from the cDNA in eeg1c.pk001.n5.f and the corresponding deduced amino acid sequence is shown in SEQ ID NO:4 and SEQ ID NO:5, respectively.

The amino acid sequence set forth in SEQ ID NO:5 was evaluated by BLASTP, yielding a pLog value of 38.70 (E value of 2e-39) versus the *Isochrysis galbana* sequence (SEQ ID NO:27). The *Euglena gracilis* delta-9 elongase is 39.4% identical to the *Isochrysis galbana* delta-9 elongase sequence using the Jotun Hein method. Sequence percent identity calculations performed by the Jotun Hein method (Hein, J. J., Meth. Enz. 183:626-445 (1990)) were done using the MegAlign™ v6.1 program of the LASARGENE bioinformatics computing suite (DNASTAR Inc., Madison, Wis.) with the default parameters for pairwise alignment (KTUPLE=2). The *Euglena gracilis* delta-9 elongase is 31.8% (SEQ ID NO:5) identical to the *Isochrysis galbana* delta-9 elongase (SEQ ID NO:27) sequence using the Clustal V method (see FIG. 16 and FIG. 29). Sequence percent identity calculations performed by the Clustal V method (Higgins, D. G. and Sharp, P. M., *Comput. Appl. Biosci.* 5:151-153 (1989); Higgins et al., *Comput Appl. Biosci.* 8:189-191 (1992)) were done using the MegAlign™ v6.1 program of the LASARGENE bioinformatics computing suite (DNASTAR Inc., Madison, Wis.) with the default parameters for pairwise alignment (KTUPLE=1, GAP PENALTY=3, WINDOW=5 and DIAGONALS SAVED=5 and GAP LENGTH PENALTY=10). BLAST scores and probabilities indicate that the instant nucleic acid fragment (SEQ ID NO:3) encode an entire *Euglena gracilis* delta-9 elongase.

Example 4

Synthesis and Functional Expression of a Codon-Optimized Delta-9 Elongase Gene (Derived from *Isochrysis galbana*) in *Yarrowia lipolytica*

The codon usage of the delta-9 elongase gene of *Isochrysis galbana* (SEQ ID NO:27, GenBank Accession No. AF390174) was optimized for expression in *Yarrowia lipolytica*. According to the *Yarrowia* codon usage pattern, the consensus sequence-around the ATG translation initiation codon, and the general rules of RNA stability (Guhaniyogi, G. and J. Brewer, *Gene* 265(1-2):11-23 (2001)), a codon-optimized delta-9 elongase gene was designed, affording SEQ ID NO:65, based on the DNA sequence of *Isochrysis galbana* (SEQ ID NO:29). In addition to modification of the translation initiation site, 127 bp of the 792 bp coding region were modified, and 122 codons were optimized. None of the modifications in the codon-optimized gene changed the amino acid sequence of the encoded protein (GenBank Accession No. AF390174; SEQ ID NO:27).

In Vitro Synthesis of a Codon-Optimized Delta-9 Elongase Gene for *Yarrowia lipolytica:*

Eight pairs of oligonucleotides were designed to extend the entire length of the codon-optimized coding region of the *Isochrysis galbana* delta-9 elongase gene (e.g., IL3-1A, IL3-1B, IL3-2A, IL3-2B, IL3-3A, IL3-3B, IL3-4A, IL34B, IL3-5A, IL3-5B, IL3-6A, IL3-6B, IL3-7A, IL3-7B, IL3-8A, IL3-8B, corresponding to SEQ ID NOs:66-81). Each pair of sense (A) and anti-sense (B) oligonucleotides were complementary, with the exception of a 4 bp overhang at each 5'-end. Additionally, primers IL3-1F, IL3-4R, IL3-5F and IL38R (SEQ ID NOs:82-85) also introduced NcoI, PstI, PstI and Not1 restriction sites, respectively, for subsequent subcloning.

Each oligonucleotide (100 ng) was phosphorylated at 37° C. for 1 h in a volume of 20 µL containing 50 mM Tris-HCl (pH 7.5), 10 mM MgCl$_2$, 10 mM DTT, 0.5 mM spermidine, 0.5 mM ATP and 10 U of T4 polynucleotide kinase. Each pair of sense and antisense oligonucleotides was mixed and annealed in a thermocycler using the following parameters: 95° C. (2 min), 85° C. (2 min), 65° C. (15 min), 37° C. (15 min), 24° C. (15 min) and 4° C. (15 min). Thus, IL3-1A (SEQ ID NO:66) was annealed to IL3-1B (SEQ ID NO:67) to produce the double-stranded product "IL3-1AB". Similarly, IL3-2A (SEQ ID NO:68) was annealed to IL3-2B (SEQ ID NO:69) to produce the double-stranded product "IL3-2AB", etc.

Two separate pools of annealed, double-stranded oligonucleotides were then ligated together, as shown below: Pool 1 (comprising IL3-1AB, IL3-2AB, IL3-3AB and IL34AB); and Pool 2 (comprising IL3-5AB, IL3-6AB, IL3-7AB and IL3-8AB). Each pool of annealed oligonucleotides was mixed in a volume of 20 µL with 10 U of T4 DNA ligase and the ligation reaction was incubated overnight at 16° C.

The product of each ligation reaction was then used as template to amplify the designed DNA fragment by PCR. Specifically, using the ligated "Pool 1" mixture (e.g., IL3-1AB, IL3-2AB, IL3-3AB and IL3-4AB) as template, and oligonucleotides IL3-1F and IL3-4R (SEQ ID NOs:82 and 83) as primers, the first portion of the codon-optimized delta-9 elongase gene was amplified by PCR. The 417 bp PCR fragment was subcloned into the pGEM-T easy vector (Promega) to generate pT9(14) (SEQ ID NO:86).

Using the ligated "Pool 2" mixture (e.g. IL3-5AB, IL3-6AB, IL3-7AB and IL3-8AB) as the template, and oligonucleotides IL3-5F and IL3-8R (SEQ ID NOs:84 and 85) as primers, the second portion of the codon-optimized delta-9 elongase gene was amplified similarly by PCR and cloned into the pGEM-T-easy vector to generate pT9(5-8) (SEQ ID NO:87).

*E. coli* was transformed separately with pT9(14) (SEQ ID NO:86) and pT9(5-8) (SEQ ID NO:87) and the plasmid DNA was isolated from ampicillin-resistant transformants. Plasmid DNA was purified and digested with the appropriate restriction endonucleases to liberate the 417 bp NcoI/PstI fragment of pT9(1-4) (SEQ ID NO:86) and the 377 bp PstI/Not1 fragment of pT9(5-8) (SEQ ID NO:87). These two fragments were then combined and directionally ligated together with Nco1/Not1 digested pZUF17 (SEQ ID NO:25) to generate pDMW237 (SEQ ID NO:26). The DNA sequence of the resulting synthetic delta-9 elongase gene ("IgD9e") in pDMW237 was exactly the same as the originally designed codon-optimized gene (e.g., SEQ ID NO:65) for *Yarrowia lipolytica*.

Example 5

Construction of pDMW263

Plasmid pY5-30 (which was previously described in PCT Publication No. WO 05/003310 (the contents of which are hereby incorporated by reference),) is a shuttle plasmid that can replicate both in *E. coli* and *Yarrowia lipolytica*. Plasmid pY5-30 contains the following: a *Yarrowia* autonomous replication sequence (ARS18); a ColE1 plasmid origin of replication; an ampicillin-resistance gene (Amp$^R$), for selection in *E. coli*; a *Yarrowia* LEU2 gene, for selection in *Yarrowia*; and a chimeric TEF::GUS::XPR gene. Plasmid pDMW263 (SEQ ID NO:89) was created from pY5-30, by replacing the TEF promoter with the *Yarrowia lipolytica* FBAINm promoter (PCT Publication No. WO 05/049805) using techniques well known to one skilled in the art. Briefly, this promoter refers to a modified promoter which is located in the 5' upstream untranslated region in front of the 'ATG' translation initiation codon of the fructose-bisphosphate aldolase enzyme (E.C. 4.1.2.13) encoded by the fba1 gene and that is necessary for expression, plus a portion of 5' coding region that has an intron, wherein FBAINm has a 52 bp deletion between the ATG translation initiation codon and the intron of the FBAIN promoter (thereby including only 22 amino acids of the N-terminus) and a new translation consensus motif after the intron. Table 4 summarizes the components of pDMW263.

TABLE 4

Components of Plasmid pDMW263

| RE Sites and Nucleotides Within SEQ ID NO: 89 | Description of Fragment and Chimeric Gene Components |
|---|---|
| 4992-4296 SalI/SacII (8505-2014) | ARS18 sequence (GenBank Accession No. A17608) FBAINm::GUS::XPR, comprising: FBAINm: FBAINm promoter (WO2005/049805) GUS: E. coli gene encoding β-glucuronidase (Jefferson, R. A. Nature. 14: 342: 837-838 (1989) XPR: ~100 bp of the 3' region of the Yarrowia Xpr gene (GenBank Accession No. M17741) |
| 6303-8505 | Yarrowia Leu2 gene (GenBank Accession No. AF260230) |

Example 6

Construction of *Yarrowia lipolytica* Expression Vector PY115 and Gateway® Destination Vector pBY1

Figure 1:
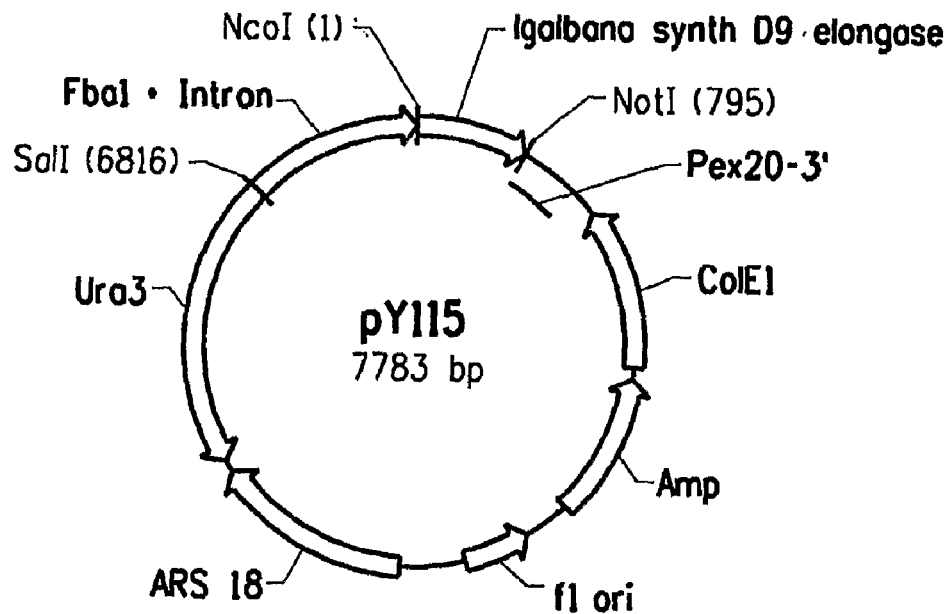
FIG. 1 is a map of plasmid pY115.

The NcoI/SalI DNA fragment from pDMW263 (see construction in Example 5), containing the *Yarrowia lipolytica* FBAINm promoter, was cloned into the NcoI/SalI DNA fragment of pDMW237 (see construction in Example 4), containing the synthetic delta-9 elongase gene (IgD9e), to produce pY115 (SEQ ID NO:30; FIG. 1).

Figure 2:
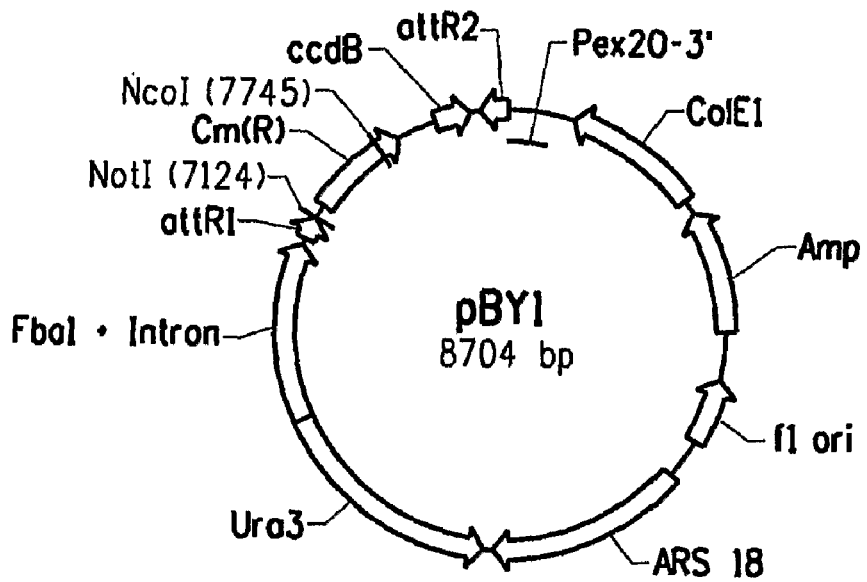
FIG. 2 is a map of *Yarrowia lipolytica* Gateway® destination vector pBY1.

Plasmid pY115 (SEQ ID NO:30) was digested with NcoI/NotI and the resulting DNA ends were filled using Klenow. After filling to form blunt ends, the DNA fragments were treated with calf intestinal alkaline phosphatase and separated using agarose gel electrophoresis. The 6989 bp fragment containing the *Yarrowia lipolytica* FBAINm promoter was excised from the agarose gel and purified using the QIAquick® Gel Extraction Kit (Qiagen Inc., Valencia, Calif.) following the manufacturer's protocol. The purified 6989 bp fragment was ligated with cassette rfA using the Gateway Vector Conversion System (Cat. No. 11823-029, Invitrogen Corporation) following the manufacturer's protocol to form *Yarrowia lipolytica* Gateway® destination vector pBY1 (SEQ ID NO:31; FIG. 2).

Example 7

Construction of *Yarrowia lipolytica* Expression-Vectors pBY2 and pBY1-FAE

Figure 3:
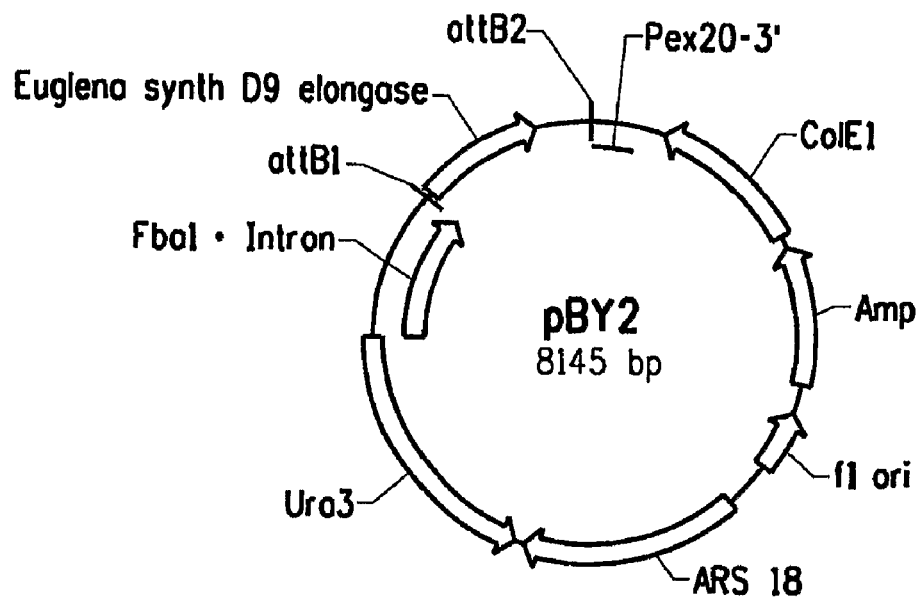
FIG. 3 is a map of plasmid pBY2.

Plasmid was purified from eeg1c.pk001.n5.f using the QIAprep® Spin Miniprep Kit (Qiagen Inc., Valencia, Calif.) following the manufacturer's protocol. Using the Gateway®D LR Clonase™ II enzyme mix (Cat. No. 11791-020, Invitrogen Corporation) and following the manufacturer's protocol, the cDNA from eeg1c.pk001.n5.f was transferred to pBY1 to form pBY2 (SEQ ID NO:32; FIG. 3). Since sequencing was performed with the WobbleT primer, the full sequence of the 3' end of eeg1c.pk001.n5.f, containing the poly A tail, was not known. Based on restriction digest and agarose gel analysis, the poly A tail appeared to be less than 100 bp long. pBY2 (SEQ ID NO:32) was transformed into *E. coli* DH10B™ (Invitrogen Corporation), cells were grown and pBY2 was isolated using the QIAprep® Spin Miniprep Kit (Qiagen Inc., Valencia, Calif.) as above.

Figure 4:
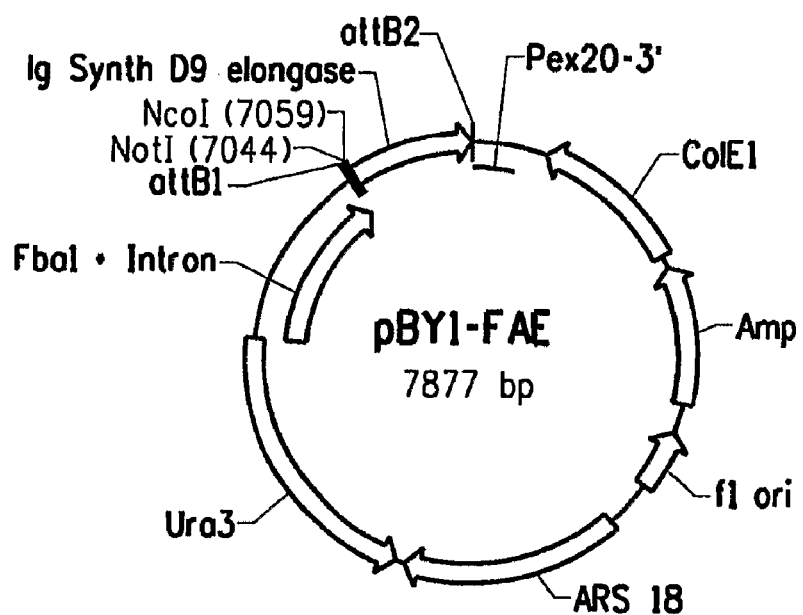
FIG. 4 is a map of plasmid pBY1-FAE.

The *Isochrysis galbana* synthetic delta-9 elongase gene (IgD9e) was amplified from pY115 (SEQ ID NO:30) with oligonucleotide primers ig-s (SEQ ID NO:6) and ig-as (SEQ ID NO:7) using the AccuPrime™ Taq Polymerase High Fidelity (Cat. No. 12346-086, Invitrogen Corporation) following the manufacturer's protocol. The resulting DNA fragment was cloned into pENTR™/D-TOPO® using the pENTR™ Directional TOPO® Cloning Kit (Invitrogen Corporation), following the manufacturer's protocol, to produce pENTR-FAE. Plasmid pENTR-FAE was purified using the QIAprep® Spin Miniprep Kit (Qiagen Inc., Valencia, Calif.) following the manufacturer's protocol as above. Using the Gateway® LR Clonase™ II enzyme mix (Cat. No. 11791-020, Invitrogen Corporation) and following the manufacturer's protocol, the CDS for the *Isochrysis galbana* synthetic delta-9 elongase gene (IgD9e) was transferred to pBY1 to form pBY1-FAE (SEQ ID NO:33; FIG. 4). pBY1-FAE was transformed into *E. coli* DH10B™ (Invitrogen Corporation), cells were grown and pBY1-FAE was isolated using the QIAprep® Spin Miniprep Kit (Qiagen Inc., Valencia, Calif.) as above.

Example 8

Construction of *Yarrowia lipolytica* Expression Vector pY120

Figure 5:
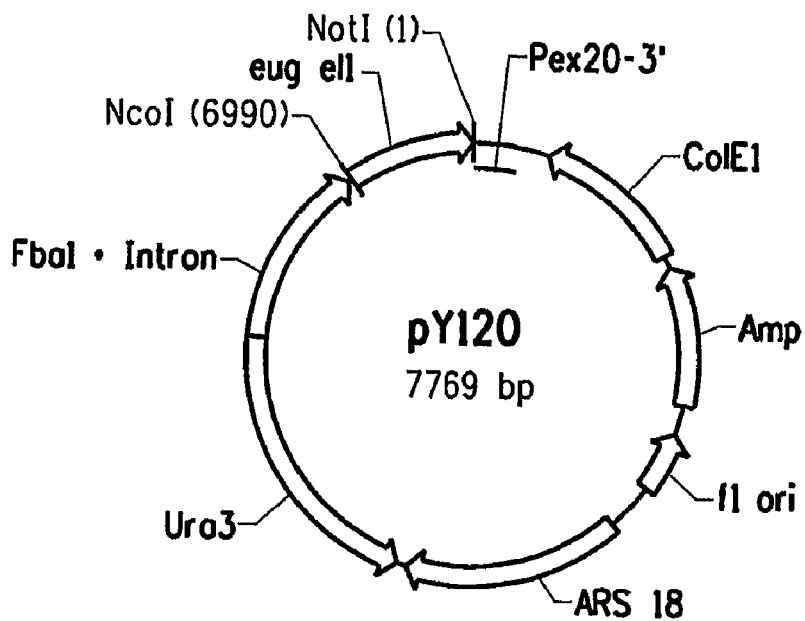
FIG. 5 is a map of plasmid pY120.

The *Euglena gracilis* delta-9 elongase was amplified from eeg1c.pk001.n5.f with oligonucleotide primers oEugEL1-1 (SEQ ID NO:8) and oEugEL1-2 (SEQ ID NO:9) using the VentR® DNA Polymerase (Cat. No. M0254S, New England Biolabs Inc., Beverly, Mass.) following the manufacturer's protocol. The resulting DNA fragment was cloned into the pCR-Blunts cloning vector using the Zero Blunt® PCR Cloning Kit (Invitrogen Corporation), following the manufacturer's protocol, to produce pKR906. The NcoI/NotI DNA fragment from pKR906, containing the *Eulgena gracilis* delta-9 elongase, was cloned into the NcoI/NotI DNA fragment from pY115, containing the *Yarrowia lipolytica* FBAINm promoter, to produce pY120 (SEQ ID NO:34; FIG. 5).

Example 9

Cloning the *Euglena gracilis* Delta-9 Elongase into a Yeast Expression Vector

Figure 6:
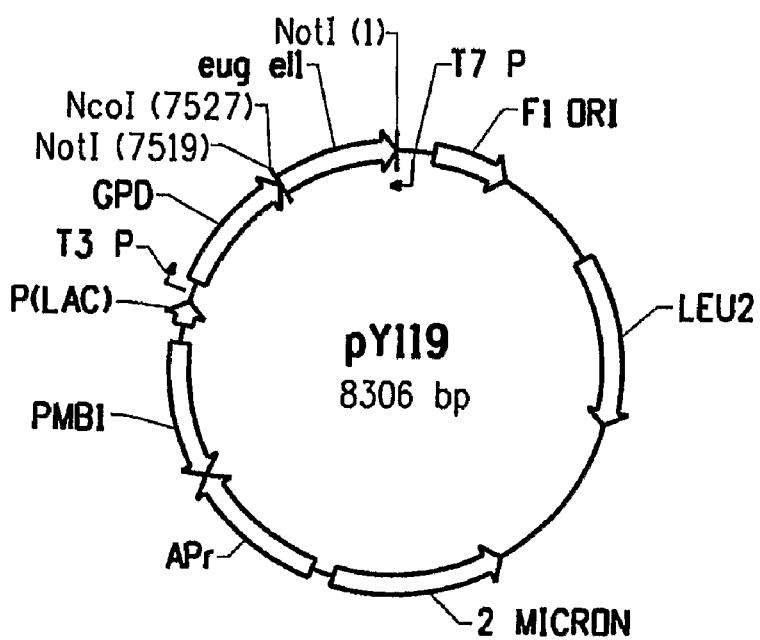
FIG. 6 is a map of plasmid pY119.

The yeast episomal plasmid (YEp)-type vector pRS425 (Christianson et al., *Gene* 110:119-122 (1992)) contains sequences from the *Saccharomyces cerevisiae* 2μ endogenous plasmid, a LEU2 selectable marker and sequences based on the backbone of a multifunctional phagemid, pBluescript II SK(+). The *Saccharomyces cerevisiae* strong, constitutive glyceraldehyde-3-phosphate dehydrogenase (GPD) promoter was cloned between the SacII and SpeI sites of pRS425 in the same way as described by Jia et al. (*Physiol. Genomics*, 3, 83-92 (2000)) to produce pGPD-425. A NotI site was introduced into the BamHI site of pGPD425, thus giving a NotI site flanked by BamHI sites, and this plasmid was called pY-75. The *Euglena gracilis* delta-9 elongase was released from pKR906 (see Example 8) by digestion with NotI and cloned into the NotI site of pY-75 to produce pY119 (SEQ ID NO:35; FIG. 6).

Example 10

Cloning the *Euglena gracilis* Delta-9 Elongase into a Soybean Expression Vector A starting plasmid pKR72 (ATCC Accession No. PTA-6019; SEQ ID NO:36, 7085 bp sequence), a derivative of pKS123 which was previously described in PCT Publication No. WO 02/008269 (the contents of which are hereby incorporated by reference), contains the hygromycin B phosphotransferase gene (HPT) (Gritz, L. and Davies, J., *Gene* 25:179-188 (1983)), flanked by the T7 promoter and transcription terminator (T7prom/hpt/T7term cassette), and a bacterial origin of replication (ori) for selection and replication in bacteria (e.g., *E. coli*). In addition, pKR72 also contains the hygromycin B phosphotransferase gene, flanked by the 35S promoter (Odell et al., *Nature* 313:810-812 (1985)) and NOS 3' transcription terminator (Depicker et al., *J. Mol. Appl. Genet.* 1:561-570 (1982)) (35S/hpt/NOS3' cassette) for selection in plants such as soybean. pKR72 also contains a NotI restriction site, flanked by the promoter for the α' subunit of β-conglycinin (Beachy et al., *EMBO J.* 4:3047-3053 (1985)) and the 3' transcription termination region of the phaseolin gene (Doyle et al., *J. Biol. Chem.* 261:9228-9238 (1986)), thus allowing for strong tissue-specific expression in the seeds of soybean of genes cloned into the NotI site.

Figure 7:
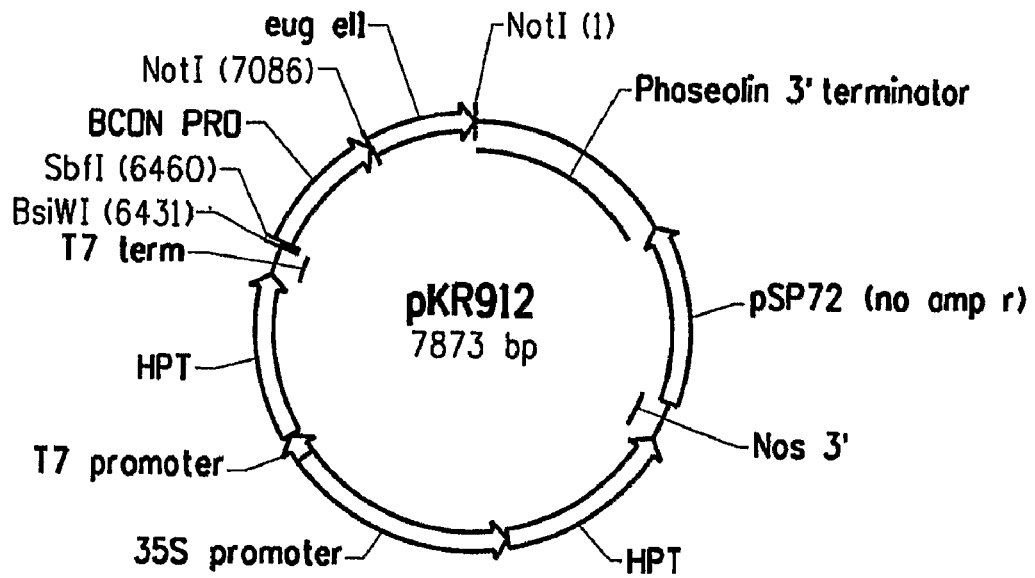
FIG. 7 is a map of plasmid pKR912.

The gene for the *Euglena gracilis* delta-9 elongase was released from pKR906 (see Example 8) by digestion with NotI and cloned into the NotI site of pKR72 to produce pKR912 (SEQ ID NO:37). A schematic depiction of pKR912 is shown in FIG. 7.

Example 11

Cloning the *Euglena gracilis* Delta-9 Elongase into an Intermediate Cloning Vector Vector pKS102 (SEQ ID NO:38), previously described in PCT Publication No. WO 02/00905 (the contents of which are hereby incorporated by reference), contains the hygromycin B phosphotransferase gene (HPT) (Gritz, L. and Davies, J., *Gene* 25:179-188 (1983)), flanked by the T7 promoter and transcription terminator (T7prom/hpt/T7term cassette), and a bacterial origin of replication (ori) for selection and replication in bacteria (e.g., *E. coli*).

Vector pKR197 (SEQ ID NO:39), previously described in PCT Publication No. WO 04/071467 (the contents of which are hereby incorporated by reference) was constructed by combining the AscI fragment from plasmid pKS102 (SEQ ID NO:38), containing the T7prom/hpt/T7term cassette and bacterial ori, with the AscI fragment of plasmid pKR72, containing the βcon/NotI/Phas cassette.

Figure 8:
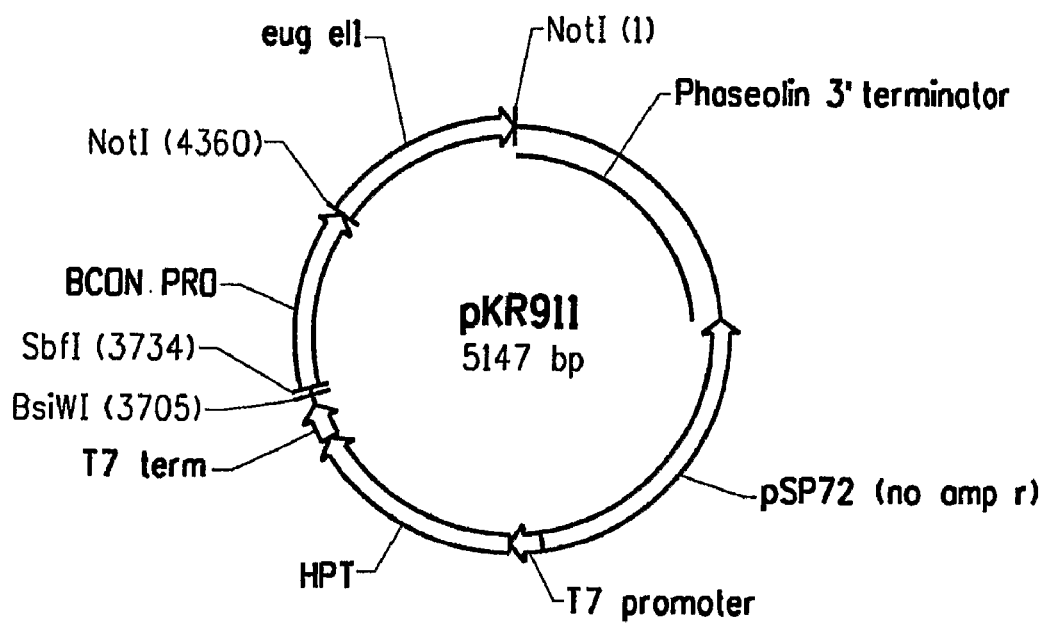
FIG. 8 is a map of plasmid pKR911.

The gene for the *Euglena gracilis* delta-9 elongase was released from pKR906 (see Example 6) by digestion with NotI and cloned into the NotI site of pKR197 to produce intermediate cloning vector pKR911 (SEQ ID NO:40). A schematic depiction of pKR911 is shown in FIG. 8.

Example 12 cDNA Synthesis and PCR of *Euglena gracilis* Delta-8 Desaturase cDNA was synthesized from 765 ng of mRNA (described in Example 1 above) using the SuperScript. Choice System for cDNA synthesis (Invitrogen™ Life Technologies, Carlsbad, Calif.) with the provided oligo(dT) primer according to the manufacturer's protocol. The synthesized cDNA was dissolved in 20 µL of water.

The *Euglena gracilis* delta-8 desaturase was amplified from cDNA with oligonucleotide primers Eg5-1 (SEQ ID NO:10) and Eg3-3 (SEQ ID NO:11) using the conditions described below.

cDNA (1 µL) from the reaction described above was combined with 50 pmol of Eg5-1 (SEQ ID NO:10), 50 pmol of Eg5-3 (SEQ ID NO:11), 1 µL of PCR nucleotide mix (10 mM, Promega, Madison, Wis.), 5 µL of 10×PCR buffer (Invitrogen Corporation), 1.5 µL of MgCl$_2$ (50 mM, Invitrogen Corporation), 0.5 µL of Taq polymerase (Invitrogen Corporation) and water to 50 µL. The reaction conditions were 94° C. for 3 min followed by 35 cycles of 94° C. for 45 sec, 55° C. for 45 sec and 72° C. for 1 min. The PCR was finished at 72° C. for 7 min and then held at 4° C. The PCR reaction was analyzed by agarose gel electrophoresis on 5 µL and a DNA band with molecular weight around 1.3 kb was observed. The remaining 45 µL of product was separated by agarose gel electrophoresis and DNA band purified using the Zymoclean™ Gel DNA Recovery Kit (Zymo Research, Orange, Calif.) following the manufacturer's protocol. The resulting DNA was cloned into the pGEM®-T Easy Vector (Promega) following the manufacturer's protocol. Multiple clones were sequenced using T7 (SEQ ID NO:12), M13-28Rev (SEQ ID NO:13), Eg3-2 (SEQ ID NO:14) and Eg5-2 (SEQ ID NO:15).

Thus, a DNA sequence for the *Euglena gracilis* delta-8 desaturase (Eg5) was obtained (SEQ ID NO:16). Translation of Eg5 gave rise to the protein sequence set forth in SEQ ID NO:17.

Example 13

Cloning the *Euglena gracilis* Delta-8 Desaturase with the *Euglena gracilis* Delta-9 Elongase Vector pKS121 (SEQ ID NO:41), which was previously described in PCT Publication No. WO 02/00904 (the contents of which are hereby incorporated by reference), contains a NotI site flanked by the Kunitz soybean Trypsin Inhibitor (KTi) promoter (Jofuku et al., *Plant Cell* 1:1079-1093 (1989)) and the KTi 3' termination region, the isolation of which is described in U.S. Pat. No. 6,372,965 (KTi/NotI/KTi3' cassette). Vector pKR457 (SEQ ID NO:42), which was previously described in PCT Publication No. WO 05/047479 (the contents of which are hereby incorporated by reference), is a derivative of pKS121 where the restriction sites upstream and downstream of the KTi/NotI/KTi3' cassette have been altered through a number of subcloning steps. Vector pKR457 also contains the soy albumin transcription terminator, which was previously described in PCT Publication No. WO 04/071467 (the contents of which are hereby incorporated by reference), downstream of the KTi terminator to lengthen and strengthen termination of transcription. In pKR457, the BamHI site upstream of the KTi promoter in the KTi/NotI/KTi3' cassette was removed and a new sequence (SEQ ID NO:18) added containing a BslWI, SalI, SbfI and HindIII site with the BslWI site being closest the 5' end of the KTi promoter.

In addition, the SalI site downstream of the KTi terminator in the KTi/NotI/KTi3' cassette from pKS121 was removed and a new sequence (SEQ ID NO:19) added containing an XbaI (closest to 3' end of KTi terminator), a BamHI site, the soy albumin transcription terminator sequence, a BslWI site and another BamHI site. The albumin transcription terminator had been previously amplified from soy genomic DNA using primer oSalb-12 (SEQ ID NO:20), designed to introduce a BslWI site at the 3' end of the terminator, and primer oSalb-13 (SEQ ID NO:21), designed to introduce a BamHI site at the 5' end of the terminator.

Eg5 (SEQ ID NO:16) was released from the pGEM®-T Easy Vector described in Example 12 by digestion with NotI and cloned into the NotI site of pKR457 to produce pKR680

Figure 9:
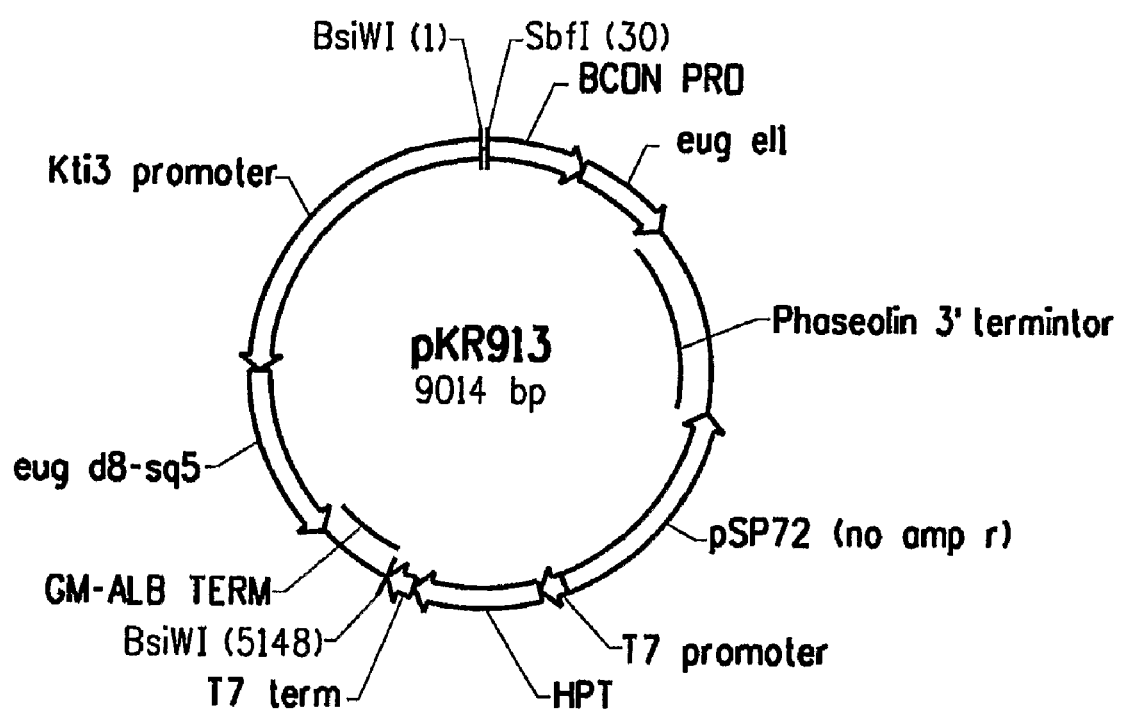
FIG. 9 is a map of plasmid pKR913.
Figures 10A, 10B:
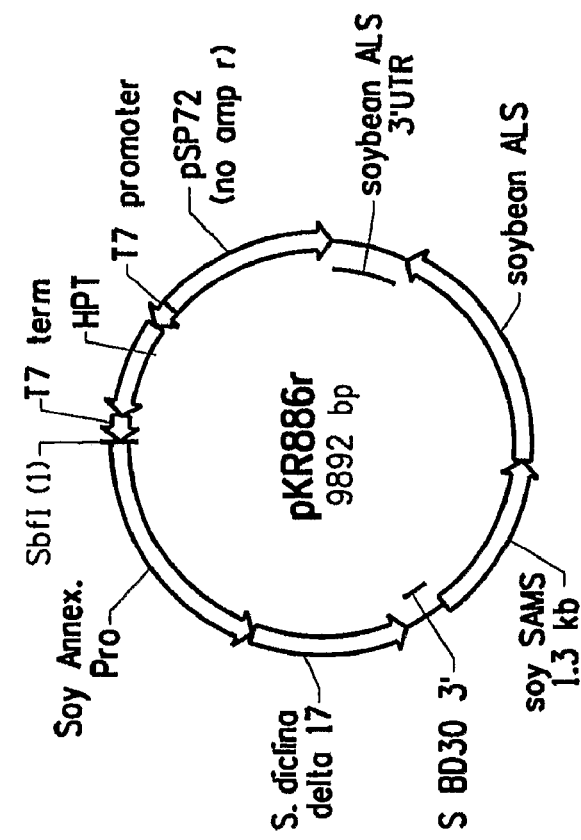
FIG. 10 is a map of plasmids pKR886 and pKR886r.

(SEQ ID NO:43). Plasmid pKR680 was then digested with BslWI and the fragment containing Eg5 (SEQ ID NO:16) was cloned into the BslWI site of pKR911 (SEQ ID NO:40) to produce pKR913 (SEQ ID NO:44). A schematic depiction of pK913 is shown in FIG. 9.

Example 14

Cloning the *Euglena gracilis* Delta-8 Desaturase into a Soybean Expression Vector and Co-Expression with the *Euglena gracilis* Delta-9 Elongase Plasmid pKR680 (SEQ ID NO:43) is digested with BslWI and the fragment containing Eg5 (SEQ ID NO:16) is cloned into the BslWI site of pKR912 (SEQ ID NO:37). In this way, the *Euglena gracilis* delta-8 desaturase is co-expressed with the *Euglena gracilis* delta-9 elongase behind strong, seed-specific promoters.

Example 15

Cloning the *Mortierella alpina* Delta-5 Desaturase into a Soybean Expression Vector and Co-Expression with the *Euglena gracilis* Delta-9 Elongase and the *Euglena gracilis* Delta-8 Desaturase A soybean expression vector containing the *Euglena gracilis* delta-8 desaturase (SEQ ID NO:16), the *Euglena gracilis* delta-9 elongase (SEQ ID NO:4) and the *Mortierella alpina* delta-5 desaturase (SEQ ID NO:88), which is described in U.S. Pat. No. 6,075,183 and PCT Publication Nos. WO 04/071467 and WO 05/0479479 (the contents of which are hereby incorporated by reference), all under the control of strong seed-specific promoters, is constructed in the following way.

Through a number of sub-cloning steps, a sequence of DNA (SEQ ID NO:22) is effectively added into the SmaI site of vector pKR287 (which is described in PCT Publication No. WO 04/071467, the contents of which are hereby incorporated by reference), to produce pKR767 (SEQ ID NO:45). In this way, a SbfI restriction site is added to the 3' end of the leg1A transcription terminator of the Gy1/Mad5/legA2 cassette, which is described in PCT Publication Nos. WO 04/071467 and WO 05/0479479.

The Gy1/Mad5/legA2 cassette is released from pKR767 by digestion with SbfI and the resulting fragment is cloned into the SbfI site of the vector described in Example 14 to produce a new vector that co-expresses all three genes under control of strong seed-specific promoters.

Example 16

Co-Expressing the *Mortierella alpina* Delta-5 Desaturase, the *Euglena gracilis* Delta-9 Elongase and the *Euglena gracilis* Delta-8 Desaturase with the *Saprolegnia diclina* Delta-17 Desaturase The soybean expression vector described in Example 15 is co-transformed along with other vectors expressing multiple different seed-specific promoter/LCPUFA-biosynthetic gene combinations. Whole plasmids or purified AscI fragments from the plasmids, containing the appropriate gene combinations, are used, as could any combination of either fragment of plasmid.

For instance, the vector described in Example 15 could be co-transformed with pKR328 (SEQ ID NO:46, described in PCT Publication No. WO 04/071467) containing the *Saprolegnia diclina* delta-17 desaturase under control of the annexin promoter and having a hygromycin resistance gene for selection in plants.

Similarly, the vector described in Example 15, could be co-transformed with pKR886 or pKR886r (FIG. 10), two vectors similar to pKR328 but having the SAMS/ALS/ALS3' cassette (which is described in PCT Publication No. WO 04/071467) for selection in plants. Vectors pKR886 (SEQ ID NO:47) and pKR886r (SEQ ID NO:48) are made by cloning the PsfI fragment, containing the Ann/Sdd17/BD30 cassette from pKR271 (SEQ ID NO:49, which is described in PCT Publication No. WO 04/071467) into the SbfI site of pKR226 (SEQ ID NO:50, which is described in PCT Publication No. WO 04/071467).

Example 17

Co-Expressing the *Mortierella alpina* Delta-5 Desaturase, the *Euglena gracilis* Delta-9 Elongase and the *Euglena gracilis* Delta-8 Desaturase with the *Saprolegnia diclina* Delta-17 Desaturase and *Arabidopsis* Fad3

Alternatively, the vector described in Example 15 could be co-transformed into soybeans with either pKR275 (SEQ ID NO:51, which is described in PCT Publication No. WO 04/071467 and has ATCC Accession Number PTA-4989) or pKR329 (SEQ ID NO:52, which is described in PCT Publication No. WO 04/07146). Plasmids pKR275 and pKR329 have ALS or hygromycin selection, respectively, and contain the KTi/Fad3/KTi3' gene cassette (which is described in PCT Publication No. WO 04/071467) in addition to the Ann/Sdd17/BD30 cassette. In this way, the *Arabidopsis* Fad3 gene could be co-expressed with the *Saprolegnia diclina* delta-17 desaturase behind strong, seed-specific promoters.

Example 18

Co-Expressing the *Mortierella alpina* Delta-5 Desaturase, the *Euglena gracilis* Delta-9 Elongase and the *Euglena gracilis* Delta-8 Desaturase with the *Saprolegnia diclina* Delta-17 Desaturase and *Fusarium moniliforme* Delta-15 Desaturase The vector described in Example 15 could be co-transformed into soybeans with pKR585 (SEQ ID NO:53, which is described in PCT Publication No. WO 05/0479479 and has ATCC Accession No. PTA-6019), having hygromycin selection and containing the *Fusarium moniliforme* delta-15 desaturase under control of the KTi promoter.

Figure 11:
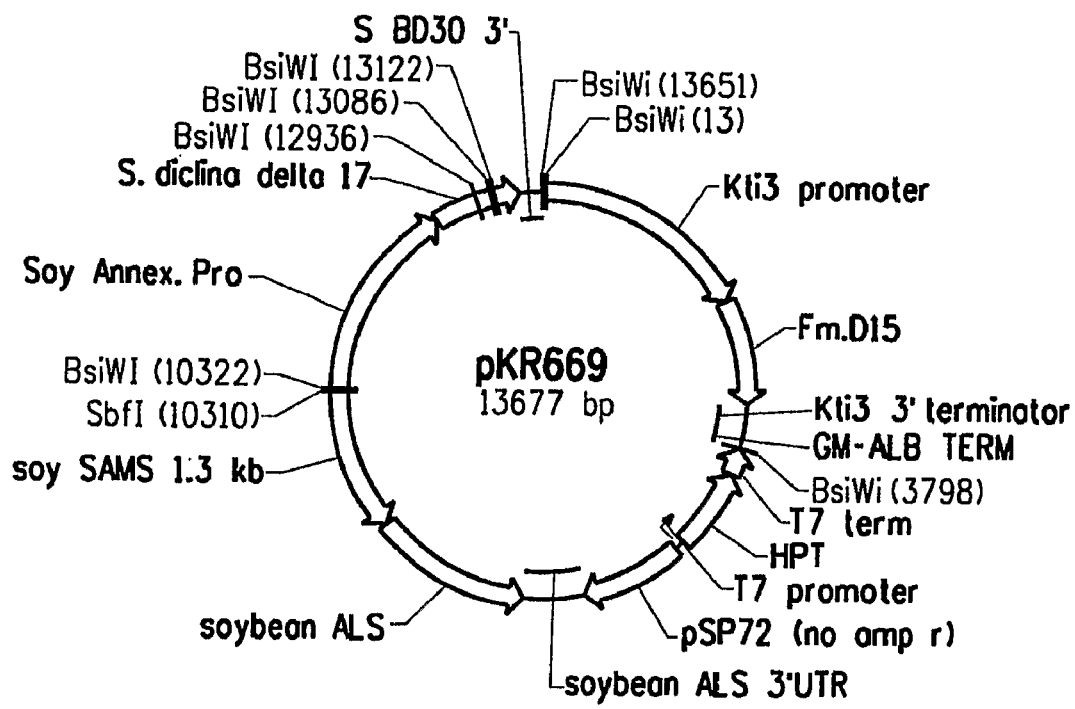
FIG. 11 is a map of plasmid pKR669.

The vector described in Example 15 could also be co-transformed into soybeans with pKR669, having ALS selection and containing the *Fusarium moniliforme* delta-15 desaturase under control of the KTi promoter in addition to the Ann/Sdd17/BD30 cassette. Plasmid pKR669 is produced in the following way. The KTi promoter:Fm delta-15 desaturase ORF:KTi terminator cassette is released from plasmid pKR578 (SEQ ID NO:54, which is described in PCT Publication No. WO 05/0479479 and has ATCC Accession No. PTA-6280) by digestion with BslWI and is cloned into the BslWI site of plasmid pKR226 (SEQ ID NO:50, which is described in PCT Publication No. WO 04/071467), containing the ALS gene for selection, the T7prom/hpt/T7term cassette and the bacterial ori region, to produce pKR667 (SEQ ID NO:55). Plasmid pKR271 (SEQ ID NO: 49, which is described in PCT Publication No. WO 04/071467) is digested with PsfI and the fragment containing the *Saprolegnia diclina* delta-17 desaturase is cloned into the SbfI site of pKR667 to produce pKR669. In this way, the *Fusarium moniliforme* delta-15 desaturase could be co-expressed with the *Saprolegnia diclina* delta-17 desaturase behind strong, seed-specific promoters. A schematic depiction of pKR669 is shown in FIG. 11.

The vector described in Example 15 could also be co-transformed into soybeans with pKR873 (SEQ ID NO:56), having ALS selection and containing the *Fusarium moniliforme* delta-15 desaturase under control of the soy albumin promoter (which is described in PCT Publication No. WO 04/071467) in addition to the Ann/Sdd17/BD30 cassette. Plasmid pKR873 is produced in the following way. The SA/NotI/SA3' cassette is amplified from plasmid pKR132 (SEQ ID NO:57, which is described in PCT Publication No. WO 04/071467) using PCR. Primer oSAlb-9 (SEQ ID NO:23) is designed to introduce XbaI and BslWI sites at the 5' end of the promoter and primer oSAlb-2 (SEQ ID NO:24) is designed to introduce BslWI and XbaI sites at the 3' end of the terminator. The resulting PCR fragment is subsequently cloned into pCR-Script AMP SK(+) (Stratagene Company, San Diego, Calif.) to produce pKR160 (SEQ ID NO:58). Plasmid pKR160 is then digested with BslWI and the SA/NotI/SA3' cassette ligated into the BslWI site of pKR124 (SEQ ID NO:59, which is described in PCT Publication No. WO 05/0479479) to produce pKR163 (SEQ ID NO:60). The NotI fragment from pY34 (SEQ ID NO:61, which is described in PCT Publication No. WO 05/0479479), containing the *Fusarium moniliforme* delta-15 desaturase, is cloned into the NotI site of pKR163 (SEQ ID NO:60) to produce pKR863 (SEQ ID NO:62). The SA/Fusd15/SA3' cassette is released from plasmid pKR863 by digestion with BslWI and is cloned into the BslWI site of plasmid pKR226 (SEQ ID NO:50, which is described in PCT Publication No. WO 04/071467), containing the ALS gene for selection, the T7prom/hpt/T7term cassette and the bacterial ori region, to produce pKR869 (SEQ ID NO:63). Plasmid pKR271 (SEQ ID NO:49, which is described in PCT Publication No. WO 04/071467) is digested with PstI and the fragment containing the *Saprolegnia diclina* delta-17 desaturase is cloned into the SbfI site of pKR869 (SEQ ID NO:63) to produce pKR873 (SEQ ID NO:56). In this way, the *Fusarium moniliforme* delta-15 desaturase could be co-expressed with the *Saprolegnia diclina* delta-17 desaturase behind strong, seed-specific promoters. A schematic depiction of pKR873 is shown in FIG. 12. Subsequent to the writing of this Example in the Provisional Application, the work describing the preparation of pKR873 was done and is described in Example 29 below.

Example 19

Co-Expressing the *Mortierella alpina* Delta-5 Desaturase, the *Euglena gracilis* Delta-9 Elongase and the *Euglena gracilis* Delta-8 Desaturase with the *Saprolegnia diclina* Delta-17 Desaturase and *Mortierella alpina* Elongase The vector described in Example 15 could also be co-transformed into soybeans with a vector having ALS selection and containing the *Mortierella alpina* elongase (which is described in PCT Publication Nos. WO 04/071467 and WO 00/12720) under control of the soy albumin promoter (which is described in PCT Publication No. WO 04/071467) in addition to the Ann/Sdd17/BD30 cassette. This plasmid could be produced in a similar way as to those described supra. For instance, the NotI fragment from pKR270 (SEQ ID NO:64, which is described in PCT Publication No. WO 04/071467), containing the *Mortierella alpina* elongase, could be cloned into the NotI site of pKR163 (SEQ ID NO:60) to produce a vector having the SA/Maelo/SA3' cassette. The SA/Maelo/SA3' cassette could be released from that plasmid by digestion with BslWI and could be cloned into the BslWI site of plasmid pKR226 (SEQ ID NO:50, which is described in PCT Publication No. WO 04/071467), containing the ALS gene for selection, the T7prom/hpt/T7term cassette and the bacterial on region, to produce a new plasmid. Plasmid pKR271 (SEQ ID NO:49, which is described in PCT Publication No. WO 04/071467) could then be digested with PstI and the fragment containing the *Saprolegnia diclina* delta-17 desaturase could be cloned into the SbfI site of the new plasmid containing the SA/Maelo/SA3' cassette. In this way, the *Mortierella alpina* elongase could be co-expressed with the *Saprolegnia diclina* delta-17 desaturase behind strong, seed-specific promoters.

Example 20

Functional Analysis of the *Euglena gracilis* Delta-9 Elongase in *Saccharomyces cerevisiae*

Plasmids pY119 and pY-75 (Example 9, cloning vector used to insert the *Euglena gracilis* delta-9 elongase yielding pY119) were transformed into *Saccharomyces cerevisiae* INVSC1 (Invitrogen Corporation) using standard lithium acetate transformation procedures. Transformants were selected on DOBA media supplemented with CSM-leu (Qbiogene, Carlsbad, Calif.). Transformants from each plate were inoculated into 2 mL of DOB medium supplemented with CSM-leu (Qbiogene) and 0.2% tergitol. Cells were grown for 1 day at 30° C. after which, 0.1 mL was transferred to 3 mL of the same medium supplemented with either linoleic acid [LA-18:2(9,12)], α-linolenic acid [ALA-18:3(9,12,15)], γ-linolenic acid [GLA-18:3(6,9,12)], stearidonic acid [STA-18:4(6,9,12,15,)], arachiconic acid [AA-20:4(5,8,11,14)] or eicosapentaenoic acid [EPA-20:5(5,8,11,14,17)] to 0.175 mM. These were incubated for 16 h at 30° C., 250 rpm and then pellets were obtained by centrifugation. Cells were washed once with water, pelleted by centrifugation and air dried. Pellets were transesterified (Roughan, G., and Nishida I. *Arch Biochem Biophys*. 276(1):38-46 (1990)) with 500 μL of 1% sodium methoxide for 30 min. at 50° C. after which 500 μL of 1 M sodium chloride and 100 μL of heptane were added. After thorough mixing and centrifugation, fatty acid methyl esters (FAMEs) were analyzed by GC as described supra. Results for feeding cells containing pY75 (vector control) or pY119 (3 independent transformants; pY119-5, pY119-6, pY119-8) are shown in FIG. 14. The elongation efficiency (% Elo) was calculated for each fatty acid fed as [% $FA_{product}$/(% $FA_{product}$+% $FA_{substrate}$)×100].

The data in FIG. 14 demonstrated that the cloned *Euglena gracilis* delta-9 elongase efficiently elongated linoleic acid [LA-8:2(9,12)] and α-linolenic acid [ALA-18:3(9,12,15)] to eicosadienoic acid [EDA-20:2(11,14)] and eicosatrienoic acid [ETrA-20:3(11,14,17)], respectively.

Additionally, FAMEs from cells where no fatty acid had been fed were analyzed by GC using slightly different temperature profiles in order to achieve separation of oleic acid [OA-18:1(9)] and vaccenic acid [VA-18:1(11)], the elongation product of palmitoleic acid-[PA-16:1(9)] elongation. Fatty acid methyl esters (3 μL injected from hexane layer) were separated and quantified using a Hewlett-Packard 6890 Gas Chromatograph fitted with an Omegawax 320 fused silica capillary column (Supelco Inc., Cat. No. 24152). The oven temperature was programmed to hold at 200° C. for 2.7 min, increase to 240° C. at 20° C./min and then hold for an additional 2.3 min. Results are shown in Table 5.

TABLE 5

Lipid Profiles Having No Exogenous Fatty Acid Added

| Sample Name | 16:0 | 16:1 (9) | 18:0 | 18:1 (9) | 18:1 (11) | % Elo 16:0 | % Elo 16:1 |
|---|---|---|---|---|---|---|---|
| pY75 | 13.1 | 54.7 | 3.5 | 27.6 | 1.2 | 20.9 | 2.1 |
| pY119-5 | 12.9 | 55.6 | 3.6 | 26.0 | 1.8 | 21.6 | 3.2 |
| pY119-6 | 13.4 | 54.0 | 3.6 | 27.3 | 1.6 | 21.2 | 3.0 |
| pY119-8 | 12.7 | 53.3 | 3.5 | 29.0 | 1.5 | 21.7 | 2.8 |

Example 21

Functional Analysis of the *Euglena gracilis* Delta-9 Elongase in *Yarrowia lipolytica*

A uracil ura3 auxotrophic strain of *Yarrowia lipolytica* (strain Y2224) was used for functional assays. *Yarrowia lipolytica* (ATCC Accession No. 20362) cells from a YPD plate were streaked onto a minimal medium plate (75 mg/L each of uracil and uridine, 6.7 g/L YNB with ammonia sulfate, without amino acid, and 20 g/L glucose) containing 250 mg/L 5-FOA (Zymo Research). Plates were incubated at 28° C. and four of the resulting colonies were patched separately onto minimal medium plates containing 200 mg/mL 5-FOA and minimal medium plates lacking uracil and uridine to confirm uracil ura3 auxotrophy.

*Yarrowia lipolytica* strain Y2224 was grown at 28° C. on YPD agar (1% yeast extract, 2% bactopeptone, 2% glucose, 2% agar). For selection of transformants, minimal medium (0.17% yeast nitrogen base (DIFCO Laboratories, Detroit, Mich.) without ammonium sulfate or amino acids, 2% glucose, 0.1% proline, pH 6.1) was used. Supplements of adenine, leucine, lysine and/or uracil are added to a final concentration of 0.01%.

Transformation of *Yarrowia lipolytica* pBY1-FAE, containing the *Isochrysis galbana* delta-9 elongase (SEQ ID NO:27), and pBY2, containing the *Euglena gracilis* delta-9 elongase were transformed into *Yarrowia lipolytica* strain Y2224 as described in the General Methods.

Briefly, *Yarrowia lipolytica* Strain #2224 was streaked onto a YPD plate and grown at 30° C. for approximately 18 h. Several large loopfuls of cells were scraped from the plate and resuspended in 1 mL of transformation buffer containing:
 2.25 mL of 50% PEG, average MW 3350;
 0.125 mL of 2 M Li acetate, pH 6.0;
 0.125 mL of 2M DTT; and
 50 µg sheared salmon sperm DNA.

About 500 ng of pBY1-FAE or pBY2 plasmid DNA was incubated in 100 µL of resuspended cells, and maintained at 39° C. for 1 h with vortex mixing at 15 min intervals. The cells were plated onto minimal media plates lacking uracil and maintained at 30° C. for 2 to 3 days Single colonies of transformant *Yarrowia lipolytica* containing pBY1-FAE or pBY2 were grown in 3 mL minimal media lacking uracil at 30° C. to an $OD_{600}$~1.0. Y2224 was also grown in a similar way on minimal media supplemented with uracil. Cells were subsequently washed with water, collected by centrifugation and lipids transesterified as described supra. FAMEs from cells containing pBY1-FAE or pBY2 were analyzed by GC as were those for cells containing pY119 in Example 13. Results for the average of three replications of each are shown in Table 6.

TABLE 6

Comparison of Lipid Profiles of *Yarrowis* Expressing Delta-9 Elongases

| Sample Name | 16:0 | 16:1 (9) | 17:1 (9) | 18:0 | 18:1 (9) | LA | EDA | % Elo LA |
|---|---|---|---|---|---|---|---|---|
| Y2224-1 | 13.4 | 12.6 | 0.8 | 2.8 | 43.1 | 27.2 | 0.1 | 0.2 |
| Y2224-2 | 12.2 | 12.3 | 0.8 | 2.3 | 46.1 | 26.2 | 0.1 | 0.2 |
| Y2224-3 | 11.7 | 10.8 | 1.1 | 2.8 | 48.4 | 25.0 | 0.1 | 0.2 |
| pBY1-FAE-1 | 11.9 | 11.9 | 0.8 | 3.1 | 50.6 | 20.2 | 1.6 | 7.5 |
| pBY1-FAE-2 | 12.9 | 11.4 | 0.9 | 3.6 | 46.7 | 23.0 | 1.4 | 5.9 |
| pBY1-FAE-3 | 12.1 | 12.5 | 0.8 | 3.2 | 50.0 | 19.8 | 1.6 | 7.4 |
| pBY2-1 | 12.3 | 11.7 | 0.8 | 3.4 | 48.4 | 21.1 | 2.2 | 9.5 |
| pBY2-2 | 12.1 | 12.5 | 0.8 | 3.2 | 50.1 | 19.1 | 2.3 | 10.6 |
| pBY2-3 | 12.1 | 12.2 | 0.8 | 3.3 | 50.0 | 19.4 | 2.1 | 9.9 |

Example 22

Cloning Other Delta-8 Desaturases or Elongases into Soybean Expression Vectors In addition to the delta-8 desaturase or delta-9 elongase from *Euglena gracilis*, other delta-8 desaturases or delta-9 elongases can be cloned into the soybean expression vectors described in the preceding Examples. For instance, a suitable delta-8 desaturase or delta-9 elongase from an organism other than *Euglena gracilis* can be cloned using methods similar to, but not limited to, the methods described herein. PCR primers designed to introduce NotI sites at the 5' and 3' ends of the delta-8 desaturase can be used to amplify the gene. The resulting PCR product can then be digested with NotI and can be cloned into a suitable soybean expression vector containing a NotI site flanked by a strong seed-specific promoter and a transcription terminator. Further sub-cloning into other vectors such as those described herein, or in WO 04/071467 or WO 05/047479, but not limited to these, should yield vectors suitable for expression and co-expression of the delta-8 desaturase and or delta-9 elongase in soybean.

Example 23

Co-Expressing Delta-5 Elongases and Delta-4 Desaturases

Delta-4 desaturases or delta-5 elongases can also be co-expressed in soybean expression vectors similar to those described herein. For instance, a delta-4 desaturase from *Schizochytrium aggregatum* (WO 02/090493) or a delta-5 elongase (EPA elongase or $C_{20/22}$ elongase) from Pavlova (WO 04/071467), can be cloned into suitable soybean expression vectors such as those described in WO 04/071467. PCR primers designed to introduce NotI sites at the 5' and 3' ends of the delta-4 desaturase or delta-5 elongase can be used to amplify the gene. The resulting PCR product can then be digested with NotI and can be cloned into a suitable soybean expression vector containing a NotI site flanked by a strong seed-specific promoter and a transcription terminator. Further su-cloning into other vectors such as those described herein, or in WO 04/071467 or WO 05/047479, but not limited to these, should yield vectors suitable for expression and co-expression of the delta-4 desaturase and or delta-5 elongase in soybean.

Example 24

Transformation of Somatic Soybean Embryo Cultures

Please also see Example 30.
Culture Conditions:

Soybean embryogenic suspension cultures (cv. Jack) can be maintained in 35 mL liquid medium SB196 (see recipes below) on rotary shaker, 150 rpm, 26° C. with cool white fluorescent lights on 16:8 h day/night photoperiod at light intensity of 60-85 µE/m2/s. Cultures are subcultured every seven days to two weeks by inoculating approximately 35 mg of tissue into 35 mL of fresh liquid SB196 (the preferred subculture interval is every seven days).

Soybean embryogenic suspension cultures can be transformed with the plasmids and DNA fragments described earlier by the method of particle gun bombardment (Klein et al., *Nature* (London) 327:70-73 (1987); U.S. Pat. No. 4,945,050). A DuPont Biolistic™ PDS1000/HE instrument (helium retrofit) would be used for all transformations.
Soybean Embryogenic Suspension Culture Initiation:

Soybean cultures are initiated twice each month with five-seven days between each initiation. Pods with immature seeds from available soybean plants 45-55 days after planting are picked, removed from their shells and placed into a sterilized magenta box. The soybean seeds are sterilized by shaking them for 15 min in a 5% Clorox solution with 1 drop of ivory soap (95 mL of autoclaved distilled water plus 5 mL Clorox and 1 drop of soap—mix well. Seeds are rinsed using 2 1-liter bottles of sterile distilled water and those less than 4 mm were placed on individual microscope slides. The small end of the seed is cut and the cotyledons pressed out of the seed coat. Cotyledons are transferred to plates containing SB1 medium (25-30 cotyledons per plate). Plates are wrapped with fiber tape and stored for eight weeks. After this time secondary embryos are cut and placed into SB196 liquid media for seven days.
Preparation of DNA for Bombardment:

Either an intact plasmid or a DNA plasmid fragment containing the genes of interest and the selectable marker gene can be used for bombardment. Fragments from plasmids such pKR274 (ATCC Accession No. PTA-4988) and pKR685 (ATCC Accession No. PTA-6047) or pKR681 (ATCC Accession No. PTA-6046) and/or other expression plasmids can be obtained by gel isolation of digested plasmids. In each case, 100 µg of plasmid DNA can be used in 0.5 mL of the specific enzyme mix described below. Plasmids could be digested with AscI (100 units) in NEBuffer 4 (20 mM Tris-acetate, 10 mM magnesium acetate, 50 mM potassium acetate, 1 mM dithiothreitol, pH 7.9), 100 µg/mL BSA, and 5 mM beta-mercaptoethanol at 37° C. for 1.5 h. The resulting DNA fragments could be separated by gel electrophoresis on 1% SeaPlaque® GTG agarose (BioWhitaker Molecular Applications) and the DNA fragments containing EPA biosynthetic genes could be cut from the agarose gel. DNA can be purified from the agarose using the GELase® digesting enzyme following the manufacturer's protocol. Alternatively, whole plasmids or a combination of whole plasmid with fragment could be used.

A 50 µL aliquot of sterile distilled water containing 3 mg of gold particles (3 mg gold) can be added to 5 µL of a 1 µg/µL DNA solution (either intact plasmid or DNA fragment prepared as described above), 50 µL 2.5M $CaCl_2$ and 20 µL of 0.1 M spermidine. The mixture is shaken 3 min on level 3 of a vortex shaker and spun for 10 sec in a bench microfuge. After a wash with 400 µL 100% ethanol the pellet is suspended by sonication in 40 µL of 100% ethanol. Five µL of DNA suspension is dispensed to each flying disk of the Biolistic PDS1000/HE instrument disk. Each 5 µL aliquot contained approximately 0.375 mg gold per bombardment (e.g., per disk).
Tissue Preparation and Bombardment with DNA:

Approximately 150-200 mg of seven day old embryonic suspension cultures are placed in an empty, sterile 60×15 mm petri dish and the dish is covered with plastic mesh. Tissue is bombarded one or two shots per plate with membrane rupture pressure set at 1100 PSI and the chamber is evacuated to a vacuum of 27-28 inches of mercury. Tissue is placed approximately 3.5 inches from the retaining/stopping screen.
Selection of Transformed Embryos:

Transformed embryos are selected either using hygromycin (when the hygromycin B phosphotransferase (HPT) gene was used as the selectable marker) or chlorsulfuron (when the acetolactate synthase (ALS) gene was used as the selectable marker).
Hygromycin (HPT) Selection:

Following bombardment, the tissue is placed into fresh SB196 media and cultured as described above. Six days post-bombardment, the SB196 is exchanged with fresh SB196 containing a selection agent of 30 mg/L hygromycin. The selection media is refreshed weekly. Four to six weeks post selection, green, transformed tissue may be observed growing from untransformed, necrotic embryogenic clusters. Isolated, green tissue is removed and inoculated into multiwell plates to generate new, clonally propagated, transformed embryogenic suspension cultures.
Chlorsulfuron (ALS) Selection:

Following bombardment, the tissue is divided between two flasks with fresh SB196 media and cultured as described above. Six to seven days post-bombardment, the SB196 is exchanged with fresh SB196 containing selection agent of 100 ng/mL chlorsulfuron. The selection media is refreshed weekly. Four to six weeks post selection, green, transformed tissue may be observed growing from untransformed, necrotic embryogenic clusters. Isolated, green tissue is removed and inoculated into multiwell plates containing SB196 to generate new, clonally propagated, transformed embryogenic suspension cultures.
Regeneration of Soybean Somatic Embryos into Plants:

In order to obtain whole plants from embryogenic suspension cultures, the tissue needs to be regenerated.
Embryo Maturation:

Embryos can be cultured for four-six weeks at 26° C. in SB196 under cool white fluorescent (Phillips cool white Econowatt F40/CW/RS/EW) and Agro (Phillips F40 Agro) bulbs (40 watt) on a 16:8 h photoperiod with light intensity of 90-120 µE/m2/s. After this time embryo clusters are removed to a solid agar media, SB166, for one-two weeks. Clusters are then subcultured to medium SB103 for three weeks. During this period, individual embryos can be removed from the clusters and screened for alterations in their fatty acid compositions as described supra. It should be noted that any detectable phenotype, resulting from the expression of the genes of interest, could be screened at this stage. This detectable phenotype would include, but not be limited to, alterations in fatty acid profile, protein profile and content; carbohydrate content, growth rate, viability, or the ability to develop normally into a soybean plant.

Embryo Desiccation and Germination:

Matured individual embryos can be desiccated by placing them into an empty, small petri dish (35×10 mm) for approximately four-seven days. The plates are sealed with fiber tape (creating a small humidity chamber). Desiccated embryos can be planted into SB71-4 medium where they are left to germinate under the same culture conditions described above. Germinated plantlets are removed from germination medium and rinsed thoroughly with water and then planted in Redi-Earth in 24-cell pack tray, covered with clear plastic dome. After two weeks the dome is removed and plants hardened off for a further week. If plantlets look hardy they are transplanted to a 10 inch pot of Redi-Earth with up to 3 plantlets per pot. After ten to sixteen weeks, mature seeds can be harvested, chipped and analyzed for fatty acids as described above.

Media Recipes:

| SB 196 - FN Lite Liquid Proliferation Medium (per liter) | |
| --- | --- |
| MS FeEDTA - 100x Stock 1 | 10 mL |
| MS Sulfate - 100x Stock 2 | 10 mL |
| FN Lite Halides - 100x Stock 3 | 10 mL |
| FN Lite P, B, Mo - 100x Stock 4 | 10 mL |
| B5 vitamins (1 mL/L) | 1.0 mL |
| 2,4-D (10 mg/L final concentration) | 1.0 mL |
| KNO$_3$ | 2.83 gm |
| (NH$_4$)$_2$SO$_4$ | 0.463 gm |
| asparagine | 1.0 gm |
| sucrose (1%) | 10 gm | pH 5.8

| FN Lite Stock Solutions | | |
| --- | --- | --- |
| Stock Number | 1000 mL | 500 mL |
| 1 - MS Fe EDTA 100x Stock | | |
| Na$_2$ EDTA* | 3.724 g | 1.862 g |
| FeSO$_4$—7H$_2$O | 2.784 g | 1.392 g |
| 2 - MS Sulfate 100x stock | | |
| MgSO$_4$—7H$_2$O | 37.0 g | 18.5 g |
| MnSO$_4$—H$_2$O | 1.69 g | 0.845 g |
| ZnSO$_4$—7H$_2$O | 0.86 g | 0.43 g |
| CuSO$_4$—5H$_2$O | 0.0025 g | 0.00125 g |
| 3 - FN Lite Halides 100x Stock | | |
| CaCl$_2$—2H$_2$O | 30.0 g | 15.0 g |
| KI | 0.083 g | 0.0715 g |
| CoCl$_2$—6H$_2$O | 0.0025 g | 0.00125 g |
| 4 - FN Lite P, B, Mo 100x Stock | | |
| KH$_2$PO$_4$ | 18.5 g | 9.25 g |
| H$_3$BO$_3$ | 0.62 g | 0.31 g |
| Na$_2$MoO$_4$—2H$_2$O | 0.025 g | 0.0125 g |

*Add first, dissolve in dark bottle while stirring

SB1 Solid Medium (Per Liter)

1 package MS salts (Gibco/BRL—Cat. No. 11117-066)
1 mL B5 vitamins 1000× stock
31.5 g sucrose
2 mL 2,4-D (20 mg/L final concentration)
pH 5.7
8 g TC agar SB 166 Solid Medium (Per Liter)

1 package MS salts (Gibco/BRL—Cat. No. 11117-066)
1 mL B5 vitamins 1000× stock
60 g maltose
750 mg MgCl$_2$ hexahydrate
5 g activated charcoal
pH 5.7
2 g gelrite SB 103 Solid Medium (Per Liter)

1 package MS salts (Gibco/BRL—Cat. No. 11117-066)
1 mL B5 vitamins 1000× stock
60 g maltose
750 mg MgCl2 hexahydrate
pH 5.7
2 g gelrite SB 71-4 Solid Medium (Per Liter)

1 bottle Gamborg's B5 salts w/sucrose (Gibco/BRL—Cat. No. 21153-036)
pH 5.7
5 g TC agar 2,4-D Stock Obtain premade from Phytotech Cat. No. D 295—concentration 1 mg/mL B5 Vitamins Stock (Per 100 mL)

Store aliquots at −20° C.
10 g myo-inositoi
100 mg nicotinic acid
100 mg pyridoxine HCl
1 g thiamine
If the solution does not dissolve quickly enough, apply a low level of heat via the hot stir plate.

Chlorsulfuron Stock 1 mg/mL in 0.01 N Ammonium Hydroxide

To induce somatic embryos, cotyledons, 3-5 mm in length dissected from surface sterilized, immature seeds of the soybean cultivar A2872, can be cultured in the light or dark at 26° C. on an appropriate agar medium for six-ten weeks. Somatic embryos, which produce secondary embryos, are then excised and placed into a suitable liquid medium. After repeated selection for clusters of somatic embryos which multiplied as early, globular staged embryos, the suspensions are maintained as described below.

Soybean embryogenic suspension cultures can be maintained in 35 mL liquid media on a rotary shaker, 150 rpm, at 26° C. with florescent lights on a 16:8 h day/night schedule. Cultures are subcultured every two weeks by inoculating approximately 35 mg of tissue into 35 mL of liquid medium.

Soybean embryogenic suspension cultures may then be transformed by the method of particle gun bombardment (Klein et al., *Nature* (London) 327:70-73, U.S. Pat. No. 4,945, 050). A DuPont Biolistic™ PDS1000/HE instrument (helium retrofit) can be used for these transformations.

A selectable marker gene which can be used to facilitate soybean transformation is a recombinant DNA construct composed of the 35S promoter from Cauliflower Mosaic Virus (Odell et al., *Nature* 313:810-812 (1985)), the hygromycin B phosphotransferase gene from plasmid pJR225 (from *E. coli*; Gritz et al., *Gene* 25:179-188 (1983)) and the 3' region of the nopaline synthase gene from the T-DNA of the Ti plasmid of *Agrobacterium tumefaciens*. The seed expression cassette comprising the phaseolin 5' region, the fragment encoding the instant polypeptide and the phaseolin 3' region can be isolated as a restriction fragment. This fragment can then be inserted into a unique restriction site of the vector carrying the marker gene.

To 50 µL of a 60 mg/mL 1 µm gold particle suspension is added (in order): 5 µL DNA (1 µg/µL), 20 µL spermidine (0.1 M), and 50 µL $CaCl_2$ (2.5 M). The particle preparation is then agitated for three minutes, spun in a microfuge for 10 sec and the supernatant removed. The DNA-coated particles are then washed once in 400 µL 70% ethanol and resuspended in 40 µL of anhydrous ethanol. The DNA/particle suspension can be sonicated three times for one sec each. Five µL of the DNA-coated gold particles are then loaded on each macro carrier disk.

Approximately 300-400 mg of a two-week-old suspension culture is placed in an empty 60×15 mm petri dish and the residual liquid removed from the tissue with a pipette. For each transformation experiment, approximately five-ten plates of tissue are normally bombarded. Membrane rupture pressure is set at 1100 psi and the chamber is evacuated to a vacuum of 28 inches mercury. The tissue is placed approximately 3.5 inches away from the retaining screen and bombarded three times. Following bombardment, the tissue can be divided in half and placed back into liquid and cultured as described above.

Five to seven days post bombardment, the liquid media may be exchanged with fresh media, and eleven to twelve days post bombardment with fresh media containing 50 mg/mL hygromycin. This selective media can be refreshed weekly. Seven to eight weeks post bombardment, green, transformed tissue may be observed growing from untransformed, necrotic embryogenic clusters. Isolated green tissue is removed and inoculated into individual flasks to generate new, clonally propagated, transformed embryogenic suspension cultures. Each new line may be treated as an independent transformation event. These suspensions can then be subcultured and maintained as clusters of immature embryos or regenerated into whole plants by maturation and germination of individual somatic embryos.

Example 25

Synthesis and Functional Expression of a Codon-Optimized Delta-9 Elongase Gene (Derived from *Euglena gracilis*) in *Yarrowia lipolytica*

The codon usage of the delta-9 elongase gene of *Euglena gracilis* (SEQ ID NOs:3 and 4) is optimized for expression in *Yarrowia lipolytica*, in a manner similar to that described in Example 4 (supra) and PCT Publication No. WO 2004/101753. Specifically, a codon-optimized delta-9 elongase gene (designated "EgD9S"), SEQ ID NO:90) is designed, based on the coding sequence of the delta-9 elongase of the instant invention (clone eeg1c.pk001.n5.f, according to the *Yarrowia* codon usage pattern (PCT Publication No. WO 2004/101753), the consensus sequence around the 'ATG' translation initiation codon, and the general rules of RNA stability (Guhaniyogi, G. and J. Brewer, *Gene* 265(1-2):11-23 (2001)). In addition to the modification of the translation initiation site, 117 bp of the 777 bp coding region are modified (15.1%) and 106 codons are optimized (40.9%). None of the modifications in the codon-optimized gene change the amino acid sequence of the encoded protein (SEQ ID NO:5). The designed EgD9 gene can be synthesized by GenScript Corporation (Piscataway, N.J.) and can be cloned into pUC57 (GenBank Accession No. Y14837) to generate pEgD9S.

Subsequent to the writing of this Example in the Provisional Application, the work describing the preparation codon-optimized *Euglena gracilis* delta-9 elongase gene (designated "EgD9S") was done and is described in Example 36 below.

Example 26

Figure 17:
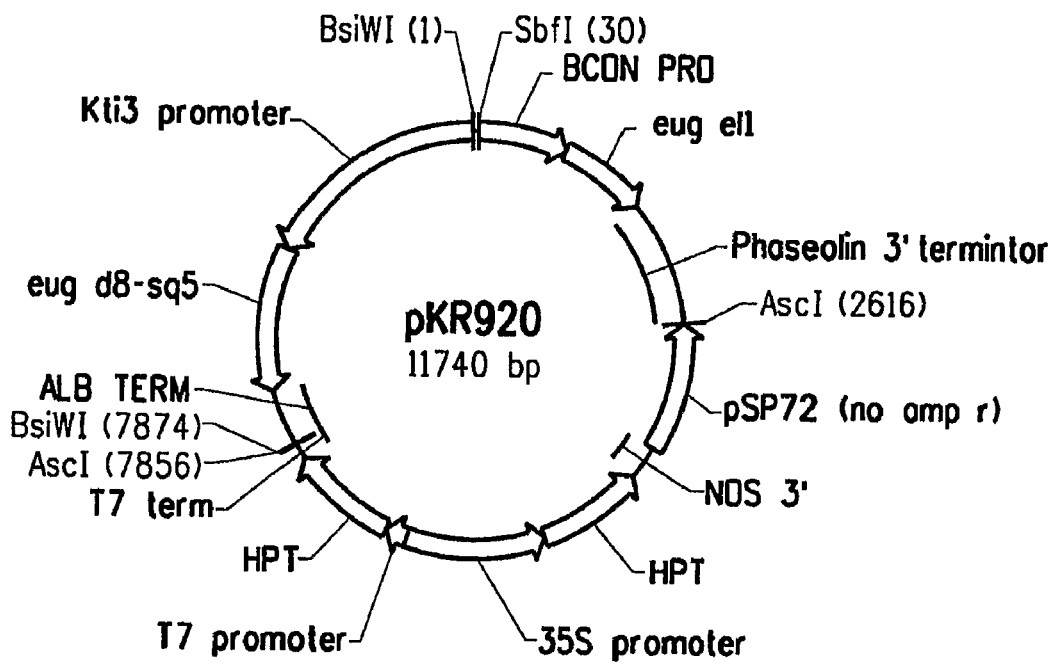
FIG. 17 is a map of plasmid pKR920.
Figure 18:
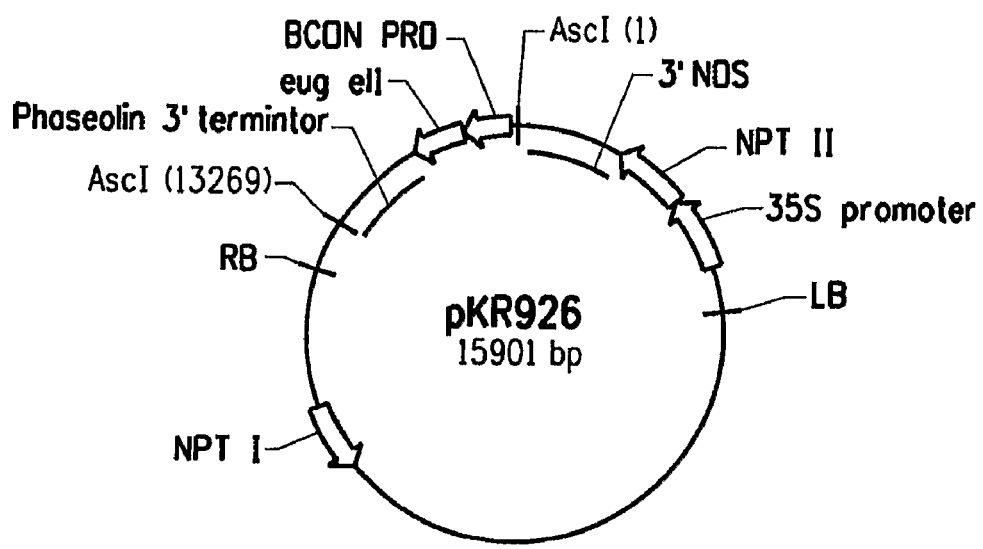
FIG. 18 is a map of plasmid pKR926.

Cloning the *Euglena gracilis* Delta-8 Desaturase into a Soybean Expression Vector and Co-Expression with the *Euglena gracilis* Delta-9 Elongase Plasmid pKR680 (SEQ ID NO:43) was digested with BslWI and the fragment containing *Euglena gracilis* delta-8 desaturase (Eg5) (SEQ ID NO:16) was cloned into the BslWI site of pKR912 (SEQ ID NO:37) to produce pKR920 (SEQ ID NO:91). A schematic depiction of pK920 is shown in FIG. 17. In this way, the *Euglena gracilis* delta-8 desaturase (called eug d8-sq5 in FIG. 17) was co-expressed with the *Euglena gracilis* delta-9 elongase (called eug el1 in FIG. 17) behind strong, seed-specific promoters.

Example 27

Cloning the *Euglena gracilis* Delta-9 Elongase into an *Arabidopsis thaliana* Binary Expression Vector (pKR926)

Various restriction sites were added, through a number of cloning steps, to the ends of the Bcon/NotI/Phas3' cassette from KS123, which was previously described in PCT Publication No. WO 02/008269 (the contents of which are hereby incorporated by reference). Briefly, a DNA fragment (cal a24-4; SEQ ID NO:92) was amplified from plasmid CalFad2-2 (described in PCT Publication No. WO 01/12800) using primers oCal-15 (SEQ ID NO:93) and oCal-6 (SEQ ID NO:94). DNA fragment cal a24-4 was digested with BglII and BamHI and cloned into the BamHI site of pKS123 to give pKR53B (SEQ ID NO:95). The XbaI/SbfI fragment of pKR53B, containing the Bcon/NotI/Phas3' cassette was cloned into the XbaI/SbfI fragment of pKR72, containing the bacterial hygromycin phosphotransferase gene, to give pKR85 (SEQ ID NO:96).

The Bcon/NotI/Phas3' cassette was amplified from plasmid pKR85 using primers oKR85-1 (SEQ ID NO:97) and oKR85-2 (SEQ ID NO:98) and the resulting DNA fragment was cloned into PCR-Script® (Stratgene) following the manufacture's protocol, to give pPCR85 (SEQ ID NO:99).

The EcoRI/BglII fragment of pPCR85, containing the Bcon/NotI/Phas3' cassette was cloned into the EcoRI/BamHI fragment of plasmid pZS199 (PCT Publication No. WO 93/11245 (also U.S. Pat. No. 5,952,544) which was published on Jun. 10, 1993, the disclosures of which are hereby incorporated by reference), containing the *Arabidopsis* binary vector backbone to produce pKR91 (SEQ ID NO:100).

The Bcon/NotI/Phas3' cassette was removed from pKR91 by digestion with AscI and the re-ligated binary vector containing a unique AscI cloning site was produced called pKR92 (SEQ ID NO:101).

The AscI fragment of pKR911 (SEQ ID NO:40; Example 11), containing the *Euglena gracilis* delta-9 elongase was cloned into the AscI site of pKR92 to give pKR926 (SEQ ID NO:102). A schematic depiction of pK926 is shown in FIG.

18. In this way, the *Euglena gracilis* delta-9 elongase (called eug el1 in FIG. 18) was expressed in *Arabidopsis* behind the soybean beta-conglycinin promoter. The soybean beta-conglycinin promoter functions as a strong, seed-specific promoter in *Arabidopsis* (see U.S. application Ser. No. 11/258, 704).

Example 28

Cloning the *Mortierella alpina* Delta-5 Desaturase into a Soybean Expression Vector and Co-Expression with the *Euglena gracilis* Delta-9 Elongase and the *Euglena gracilis* Delta-8 Desaturase (pKR916)

A soybean expression vector containing the *Euglena gracilis* delta-8 desaturase (SEQ ID NO:16), the *Euglena gracilis* delta-9 elongase (SEQ ID NO:4) and the *Mortierella alpina* delta-5 desaturase (SEQ ID NO:88), which is described in U.S. Pat. No. 6,075,183 and PCT Publication Nos. WO 04/071467 and WO 05/0479479 (the contents of which are hereby incorporated by reference), all under the control of strong seed-specific promoters, was constructed in the following way.

Figure 19:
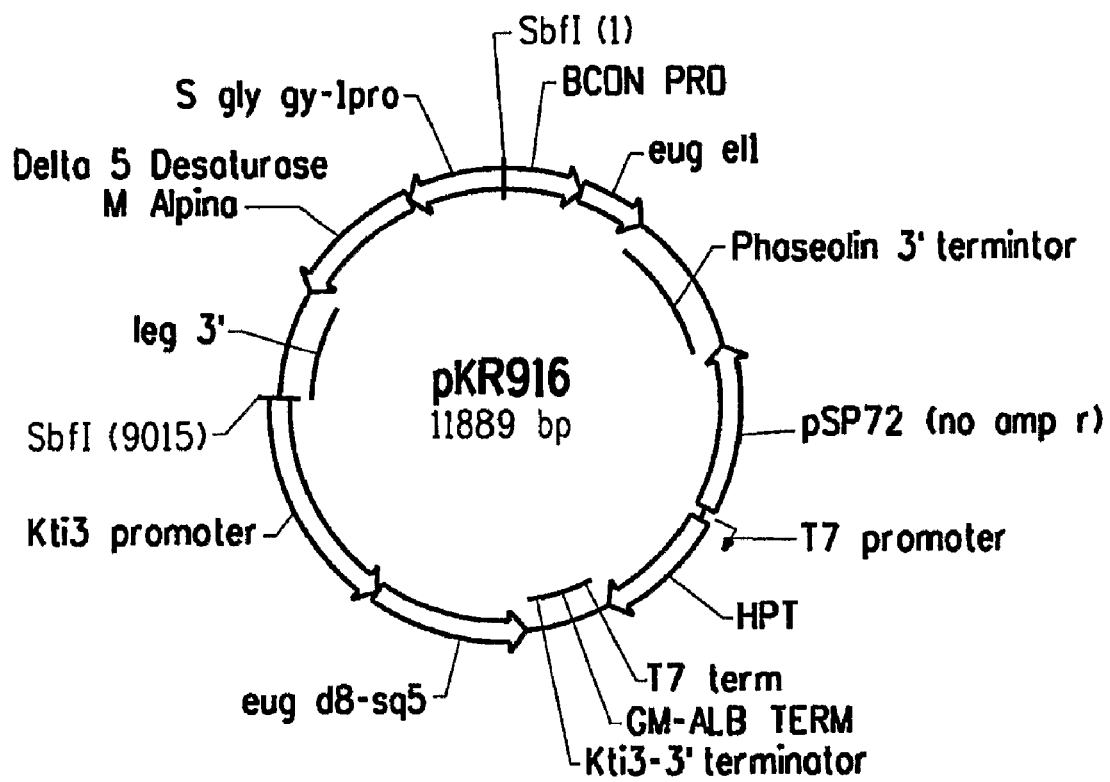
FIG. 19 is a map of plasmid pKR916.

The Gy1/Mad5/legA2 cassette was released from pKR767 (SEQ ID NO:103) by digestion with SbfI and the resulting fragment was cloned into the SbfI site of pKR913 (SEQ ID NO:44; Example 13) to produce pKR916 (SEQ ID NO:104). A schematic depiction of pKR916 is shown in FIG. 19. In this way, the *Euglena gracilis* delta-9 elongase (called eug el1 in FIG. 19) was co-expressed with the *Euglena gracilis* delta-8 desaturase (called eug d8-sq5 in FIG. 19) and the *Mortierella alpina* delta-5 desaturase (called DELTA 5 DESATURASE M ALPINA in FIG. 19) behind strong, seed specific promoters.

Example 29

Co-Expressing the *Saprolegnia diclina* Delta-17 Desaturase with the *Fusarium moniliforme* Delta-15 Desaturase (pKR873)

Figure 12:
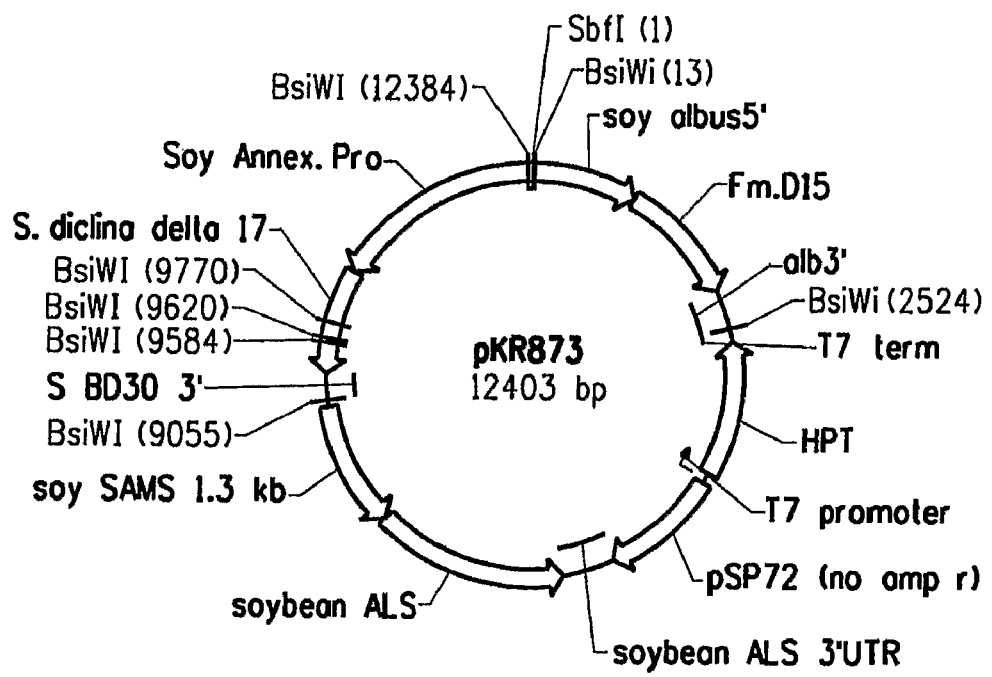
FIG. 12 is a map of plasmid pKR873.

Plasmid pKR873 (SEQ ID NO:56; FIG. 12) was produced in the following way. The SA/NotI/SA3' cassette was amplified from plasmid pKR132 (SEQ ID NO:57, which is described in PCT Publication No. WO 04/071467) using PCR. Primer oSAlb-9 (SEQ ID NO:23) was designed to introduce XbaI and BslWI sites at the 5' end of the promoter and primer oSAlb-2 (SEQ ID NO:24) was designed to introduce BslWI and XbaI sites at the 3' end of the terminator. The resulting PCR fragment was subsequently cloned into pCR-Script AMP SK(+) (Stratagene Company, San Diego, Calif.) to produce pKR160 (SEQ ID NO:58).

Plasmid pKR160 was then digested with BslWI and the SA/NotI/SA3' cassette ligated into the BslWI site of pKR124 (SEQ ID NO:59, which is described in PCT Publication No. WO 05/0479479) to produce pKR163 (SEQ ID NO:60). The NotI fragment from pY34 (SEQ ID NO:61, which is described in PCT Publication No. WO 05/0479479), containing the *Fusarium moniliforme* delta-15 desaturase, was cloned into the NotI site of pKR163 (SEQ ID NO:60) to produce pKR863 (SEQ ID NO:62). The SA/Fusd15/SA3' cassette was released from plasmid pKR863 by digestion with BslWI and was cloned into the BslWI site of plasmid pKR226 (SEQ ID NO:50, which is described in PCT Publication No. WO 04/071467), containing the ALS gene for selection, the T7prom/hpt/T7term cassette and the bacterial ori region, to produce pKR869 (SEQ ID NO:63). Plasmid pKR271 (SEQ ID NO:49, which is described in PCT Publication No. WO 04/071467) was digested with PstI and the fragment containing the *Saprolegnia diclina* delta-17 desaturase was cloned into the SbfI site of pKR869 (SEQ ID NO:63) to produce pKR873 (SEQ ID NO:56). In this way, the *Fusarium moniliforme* delta-15 desaturase was co-expressed with the *Saprolegnia diclina* delta-17 desaturase behind strong, seed-specific promoters. A schematic depiction of pKR873 is shown in FIG. 12.

Example 30

Transformation of Somatic Soybean Embryo Cultures with Soybean Expression Vectors Culture Conditions:

Soybean embryogenic suspension cultures (cv. Jack) were maintained in 35 mL liquid medium SB196 (infra) on a rotary shaker, 150 rpm, 26° C. with cool white fluorescent lights ori 16:8 hr day/night photoperiod at light intensity of 60-85 µE/m2/s. Cultures were subcultured every 7 days to two weeks by inoculating approximately 35 mg of tissue into 35 mL of fresh liquid SB196 (the preferred subculture interval is every 7 days).

Soybean embryogenic suspension cultures were transformed with the soybean expression plasmids by the method of particle gun bombardment (Klein et al., *Nature,* 327:70 (1987)) using a DuPont Biolistic PDS1000/HE instrument (helium retrofit) for all transformations.

Soybean Embryogenic Suspension Culture Initiation:

Soybean cultures were initiated twice each month with 5-7 days between each initiation. Pods with immature seeds from available soybean plants were picked 45-55 days after planting. Seeds were removed from the pods and placed into a sterilized magenta box. The soybean seeds were sterilized by shaking them for 15 min in a 5% Clorox solution with 1 drop of ivory soap (i.e., 95 mL of autoclaved distilled water plus 5 mL Clorox and 1 drop of soap, mixed well). Seeds were rinsed using 2 1-liter bottles of sterile distilled water and those less than 4 mm were placed on individual microscope slides. The small end of the seed was cut and the cotyledons pressed out of the seed coat. When cultures were being prepared for production transformation, cotyledons were transferred to plates containing SB1 medium (25-30 cotyledons per plate). Plates were wrapped with fiber tape and were maintained at 26° C. with cool white fluorescent lights on 16:8 h day/night photoperiod at light intensity of 60-80 µE/m2/s for eight weeks, with a media change after 4 weeks. When cultures were being prepared for model system experiments, cotyledons were transferred to plates containing SB199 medium (25-30 cotyledons per plate) for 2 weeks, and then transferred to SB1 for 2-4 weeks. Light and temperature conditions were the same as described above. After incubation on SB1 medium, secondary embryos were cut and placed into SB196 liquid media for 7 days.

Preparation of DNA for Bombardment:

Either an intact plasmid or a DNA plasmid fragment containing the genes of interest and the selectable marker gene were used for bombardment. Fragments from soybean expression plasmids, the construction of which is described herein, were obtained by gel isolation of digested plasmids. In each case, 100 µg of plasmid DNA was used in 0.5 mL of the specific enzyme mix described below. Plasmids were digested with AscI (100 units) in NEBuffer 4 (20 mM Tris-acetate, 10 mM magnesium acetate, 50 mM potassium acetate, 1 mM dithiothreitol, pH 7.9), 100 µg/mL BSA, and 5 mM beta-mercaptoethanol at 37° C. for 1.5 hr. The resulting DNA fragments were separated by gel electrophoresis on 1% SeaPlaque GTG agarose (BioWhitaker Molecular Applications) and the DNA fragments containing gene cassettes were cut from the agarose gel. DNA was purified from the agarose using the GELase digesting enzyme following the manufacturer's protocol.

A 50 µL aliquot of sterile distilled water containing 3 mg of gold particles (3 mg gold) was added to 30 µL of a 10 ng/µL DNA solution (either intact plasmid or DNA fragment prepared as described herein), 25 µL 5M $CaCl_2$ and 20 µL of 0.1 M spermidine. The mixture was shaken 3 min on level 3 of a vortex shaker and spun for 10 sec in a bench microfuge. The supernatant was removed, followed by a wash with 400 µL 100% ethanol and another brief centrifugation. The 400 µl ethanol was removed and the pellet was resuspended in 40 µL of 100% ethanol. Five µL of DNA suspension was dispensed to each flying disk of the Biolistic PDS1000/HE instrument disk. Each 5 µL aliquot contained approximately 0.375 mg gold per bombardment (e.g., per disk).

For model system transformations, the protocol was identical except for a few minor changes (i.e., 1 mg of gold particles was added to 5 µL of a 1 µg/µL DNA solution, 50 µL of a 2.5M $CaCl_2$ was used and the pellet was ultimately resuspended in 85 µL of 100% ethanol thus providing 0.058 mg of gold particles per bombardment).

Tissue Preparation and Bombardment with DNA:

Approximately 150-200 mg of seven day old embryogenic suspension cultures was placed in an empty, sterile 60×15 mm petri dish and the dish was covered with plastic mesh. The chamber was evacuated to a vacuum of 27-28 inches of mercury, and tissue was bombarded one or two shots per plate with membrane rupture pressure set at 1100 PSI. Tissue was placed approximately 3.5 inches from the retaining/stopping screen. Model system transformation conditions were identical except 100-150 mg of embryogenic tissue was used, rupture pressure was set at 650 PSI and tissue was place approximately 2.5 inches from the retaining screen.

Selection of Transformed Embryos:

Transformed embryos were selected either using hygromycin (when the hygromycin B phosphotransferase (HPT) gene was used as the selectable marker) or chlorsulfuron (when the acetolactate synthase (ALS) gene was used as the selectable marker).

Following bombardment, the tissue was placed into fresh SB196 media and cultured as described above. Six to eight days post-bombardment, the SB196 was exchanged with fresh SB196 containing either 30 mg/L hygromycin or 100 ng/mL chlorsulfuron, depending on the selectable marker used. The selection media was refreshed weekly. Four to six weeks post-selection, green, transformed tissue was observed growing from untransformed, necrotic embryogenic clusters. Isolated, green tissue was removed and inoculated into multiwell plates to generate new, clonally propagated, transformed embryogenic suspension cultures.

Embryo Maturation:

Transformed embryogenic clusters from production transformation were cultured for four-six weeks (one-three weeks for model system) in multiwell plates as described above at 26° C. in SB196 under cool white fluorescent (Phillips cool white Econowatt F40/CW/RS/EW) and Agro (Phillips F40 Agro) bulbs (40 watt) on a 16:8 hr photoperiod with light intensity of 90-120 $\mu E/m^2 s$. After this time embryo clusters were removed to a solid agar media, SB166, for one-two weeks (1 week for model system) and then subcultured to SB103 medium for 3-4 weeks to mature embryos. After maturation on plates in SB103, individual embryos were removed from the clusters, dried and screened for alterations in their fatty acid compositions as described supra. When desired, plants were obtained from some events as described below.

Alternatively, in some model system experiments, embryos were matured in soybean histodifferentiation and maturation liquid medium (SHaM liquid media; Schmidt et al., *Cell Biology and Morphogenesis* 24:393 (2005)) using a modified procedure. Briefly, after 4 weeks of selection in SB196 as described above, embryo clusters were removed to 35 mL of SB228 (SHaM liquid media) in a 250 mL Erlenmeyer flask. Tissue was maintained in SHaM liquid media on a rotary shaker at 130 rpm and 26° C. with cool white fluorescent lights on a 16:8 hr day/night photoperiod at a light intensity of 60-85 µE/m2/s for 2-3 weeks as embryos matured. Embryos grown for 2-3 weeks in SHaM liquid media were equivalent in size and fatty acid content to embryos cultured on SB166/SB103 for 5-8 weeks.

After maturation in SHaM liquid media, individual embryos were removed from the clusters, dried and screened for alterations in their fatty acid compositions as described supra. When desired, plants were obtained from some events as described below.

Embryo Desiccation and Germination:

Matured individual embryos were desiccated by placing them into an empty, small petri dish (60×15 mm) for approximately four-seven days. The plates were sealed with fiber tape (creating a small humidity chamber). Desiccated embryos were planted into SB71-4 medium where they were left to germinate under the same culture conditions described above. Germinated plantlets were removed from germination medium and rinsed thoroughly with water and then planted in Redi-Earth in a 24-cell pack tray, and covered with a clear plastic dome. After one-two weeks the dome was removed and plants hardened off for a further week. If plantlets look hardy they were transplanted to a 10 inch pot of Redi-Earth with up to 3 plantlets per pot. After ten to sixteen weeks, mature seeds were harvested, chipped and analyzed for fatty acids as described herein.

Media Recipes:

| SB 196 - FN Lite Liquid Proliferation Medium (per liter) | |
| --- | --- |
| MS FeEDTA - 100x Stock 1 | 10 mL |
| MS Sulfate - 100x Stock 2 | 10 mL |
| FN Lite Halides - 100x Stock 3 | 10 mL |
| FN Lite P, B, Mo - 100x Stock 4 | 10 mL |
| B5 vitamins (1 mL/L) | 1.0 mL |
| 2,4-D (10 mg/L final concentration) | 1.0 mL |
| $KNO_3$ | 2.83 gm |
| $(NH_4)_2SO_4$ | 0.463 gm |
| asparagine | 1.0 gm |
| sucrose (1%) | 10 gm | pH 5.8

| FN Lite Stock Solutions | | |
| --- | --- | --- |
| Stock Number | 1000 mL | 500 mL |
| 1 MS Fe EDTA 100x Stock | | |
| $Na_2$ EDTA* | 3.724 g | 1.862 g |
| $FeSO_4$—$7H_2O$ | 2.784 g | 1.392 g |
| 2 MS Sulfate 100x stock | | |
| $MgSO_4$—$7H_2O$ | 37.0 g | 18.5 g |
| $MnSO_4$—$H_2O$ | 1.69 g | 0.845 g |
| $ZnSO_4$—$7H_2O$ | 0.86 g | 0.43 g |
| $CuSO_4$—$5H_2O$ | 0.0025 g | 0.00125 g |

FN Lite Stock Solutions

| Stock Number | 1000 mL | 500 mL |
|---|---|---|
| 3 FN Lite Halides 100x Stock | | |
| $CaCl_2$—$2H_2O$ | 30.0 g | 15.0 g |
| KI | 0.083 g | 0.0715 g |
| $CoCl_2$—$6H_2O$ | 0.0025 g | 0.00125 g |
| 4 FN Lite P, B, Mo 100x Stock | | |
| $KH_2PO_4$ | 18.5 g | 9.25 g |
| $H_3BO_3$ | 0.62 g | 0.31 g |
| $Na_2MoO_4$—$2H_2O$ | 0.025 g | 0.0125 g |

*Add first, dissolve in dark bottle while stirring

SB1 Solid Medium (Per Liter)

1 package MS salts (Gibco/BRL—Cat. No. 11117-066)
1 mL B5 vitamins 1000× stock
31.5 g glucose
2 mL 2,4-D (20 mg/L final concentration)
pH 5.7
8 g TC agar

SB199 Solid Medium (Per Liter)

1 package MS salts (Gibco/BRL—Cat. No. 11117-066)
1 mL B5 vitamins 1000× stock
30 g Sucrose
4 ml 2,4-D (40 mg/L final concentration)
pH 7.0
2 gm Gelrite

SB 166 Solid Medium (Per Liter)

1 package MS salts (Gibco/BRL—Cat. No. 11117-066)
1 mL B5 vitamins 1000× stock
60 g maltose
750 mg $MgCl_2$ hexahydrate
5 g activated charcoal
pH 5.7
2 g gelrite

SB 103 Solid Medium (Per Liter)

1 package MS salts (Gibco/BRL—Cat. No. 11117-066)
1 mL B5 vitamins 1000× stock
60 g maltose
750 mg MgCl2 hexahydrate
pH 5.7
2 g gelrite

SB 71-4 Solid Medium (Per Liter)

1 bottle Gamborg's B5 salts w/sucrose (Gibco/BRL—Cat. No; 21153-036)
pH 5.7
5 g TC agar

2,4-D Stock

Obtain premade from Phytotech Cat. No. D 295—concentration 1 mg/mL

B5 Vitamins Stock (Per 100 mL)

Store aliquots at −20° C.
10 g myo-inositol
100 mg nicotinic acid
100 mg pyridoxine HCl
1 g thiamine If the solution does not dissolve quickly enough, apply a low level of heat via the hot stir plate.

| SB 228- Soybean Histodifferentiation & Maturation (SHaM) (per liter) | |
|---|---|
| DDI $H_2O$ | 600 mL |
| FN-Lite Macro Salts for SHaM 10X | 100 mL |
| MS Micro Salts 1000x | 1 mL |
| MS FeEDTA 100x | 10 mL |
| CaCl 100x | 6.82 mL |
| B5 Vitamins 1000x | 1 mL |
| L-Methionine | 0.149 g |
| Sucrose | 30 g |
| Sorbitol | 30 g |
| Adjust volume to 900 mL | |
| pH 5.8 | |
| Autoclave | |
| Add to cooled media (≦30° C.): | |
| *Glutamine (final concentration 30 mM) 4% | 110 mL |

*Note:
Final volume will be 1010 mL after glutamine addition.

Since glutamine degrades relatively rapidly, it may be preferable to add immediately prior to using media. Expiration 2 weeks after glutamine is added; base media can be kept longer w/o glutamine.

| FN-lite Macro for SHAM 10X- Stock #1 (per liter) | |
|---|---|
| $(NH_4)2SO_4$ (ammonium sulfate) | 4.63 g |
| $KNO_3$ (potassium nitrate) | 28.3 g |
| $MgSO_4*7H_2O$ (magnesium sulfate heptahydrate) | 3.7 g |
| $KH_2PO_4$ (potassium phosphate, monobasic) | 1.85 g |
| Bring to volume | |
| Autoclave | |

| MS Micro 1000X- Stock #2 (per 1 liter) | |
|---|---|
| $H_3BO_3$ (boric acid) | 6.2 g |
| $MnSO_4*H_2O$ (manganese sulfate monohydrate) | 16.9 g |
| $ZnSO4*7H20$ (zinc sulfate heptahydrate) | 8.6 g |
| $Na_2MoO_4*2H20$ (sodium molybdate dihydrate) | 0.25 g |
| $CuSO_4*5H_2O$ (copper sulfate pentahydrate) | 0.025 g |
| $CoCl_2*6H_2O$ (cobalt chloride hexahydrate) | 0.025 g |
| KI (potassium iodide) | 0.8300 g |
| Bring to volume | |
| Autoclave | |

| FeEDTA 100X- Stock #3 (per liter) | |
|---|---|
| $Na_2EDTA*$ (sodium EDTA) | 3.73 g |
| $FeSO_4*7H_2O$ (iron sulfate heptahydrate) | 2.78 g |
| Bring to Volume | |
| Solution is photosensitive. Bottle(s) should be wrapped in foil to omit light. | |
| Autoclave | |

*EDTA must be completely dissolved before adding iron.

| Ca 100X- Stock #4 (per liter) | |
| --- | --- |
| $CaCl_2 \cdot 2H_2O$ (calcium chloride dihydrate) | 44 g |
| Bring to Volume | |
| Autoclave | |

| B5 Vitamin 1000X- Stock #5 (per liter) | |
| --- | --- |
| Thiamine*HCl | 10 g |
| Nicotinic Acid | 1 g |
| Pyridoxine*HCl | 1 g |
| Myo-Inositol | 100 g |
| Bring to Volume | |
| Store frozen | |

| 4% Glutamine- Stock #6 (per liter) | |
| --- | --- |
| DDI water heated to 30° C. | 900 mL |
| L-Glutamine | 40 g |
| Gradually add while stirring and applying low heat. | |
| Do not exceed 35° C. | |
| Bring to Volume | |
| Filter Sterilize | |
| Store frozen* | |

*Note:
Warm thawed stock in 31° C. bath to fully dissolve crystals.

Example 31

Functional Analysis of the *Euglena gracilis* Delta-9 Elongase in Somatic Soybean Embryos Transformed with Soybean Expression Vector pKR912

Mature somatic soybean embryos are a good model for zygotic embryos. While in the globular embryo state in liquid culture, somatic soybean embryos contain very low amounts of triacylglycerol or storage proteins typical of maturing, zygotic soybean embryos. At this developmental stage, the ratio of total triacylglyceride to total polar lipid (phospholipids and glycolipid) is about 1:4, as is typical of zygotic soybean embryos at the developmental stage from which the somatic embryo culture was initiated. At the globular stage as well, the mRNAs for the prominent seed proteins, α'-subunit of β-conglycinin, kunitz trypsin inhibitor 3, and seed lectin are essentially absent. Upon transfer to hormone-free media to allow differentiation to the maturing somatic embryo state, triacylglycerol becomes the most abundant lipid class. As well, mRNAs for α'-subunit of β-conglycinin, kunitz trypsin inhibitor 3 and seed lectin become very abundant messages in the total mRNA population. On this basis, the somatic soybean embryo system behaves very similarly to maturing zygotic soybean embryos in vivo, and is thus a good and rapid model system for analyzing the phenotypic effects of modifying the expression of genes in the fatty acid biosynthesis pathway (see PCT Publication No. WO 2002/00904, Example 3). Most importantly, the model system is also predictive of the fatty acid composition of seeds from plants derived from transgenic embryos.

Fatty Acid Analysis of Transgenic Somatic Soybean Embryos Expressing pKR912

Individual single, matured, somatic soybean embryos that had been transformed with pKR912 (SEQ ID NO:37; FIG. 7) and matured in the model system on SB103 plates as described in Example 30, with hygromycin as selection, were picked into glass GC vials and fatty acid methyl esters were prepared by transesterification. For transesterification, 50 μL of trimethylsulfonium hydroxide (TMSH) and 0.5 mL of hexane were added to the embryos in glass vials and incubated for 30 min at room temperature while shaking. Fatty acid methyl esters (5 μL injected from hexane layer) were separated and quantified using a Hewlett-Packard 6890 Gas Chromatograph fitted with an Omegawax 320 fused silica capillary column (Catalog #24152, Supelco Inc.). The oven temperature was programmed to hold at 220° C. for 2.6 min, increase to 240° C. at 20° C./min and then hold for an additional 2.4 min. Carrier gas was supplied by a Whatman hydrogen generator. Retention times were compared to those for methyl esters of standards commercially available (Nu-Chek Prep, Inc.). Routinely, 5-10 embryos per event were analyzed by GC, using the methodology described above.

Individual embryo fatty acid profiles for each event (5 embryos each) containing pKR912 were obtained from a total of 44 events. Of the 44 events, 37 events had at least 1 embryo with greater than 1% EDA and/or ERA. The lipid profiles of somatic soybean embryos expressing the *Euglena gracilis* delta-9 elongase for the top 5 events are shown in FIG. 20. Fatty acids are identified as 16:0 (palmitate), 18:0 (stearic acid), 18:1 (oleic acid), LA, ALA, EDA, and ERA; and, fatty acid compositions listed in FIG. 20 are expressed as a weight percent (wt. %) of total fatty acids. The activity of the *Euglena gracilis* delta-9 elongase is expressed as percent delta-9 elongation (% Elong), calculated according to the following formula: ([product]/[substrate+product])*100.

More specifically, the combined percent elongation for LA and ALA is shown as "delta-9% Elong", determined as: ([EDA+ERA]/[LA+ALA+EDA+ERA])*100. This elongation is also referred to as the overall % elongation. The individual omega-6 delta-9 elongation ("LA % Elong") was calculated as: ([EDA]/[LA+EDA])*100. Similarly, the individual omega-3 delta-9 elongation ("ALA % Elong") was calculated as: ([ERA]/[ALA+ERA])*100. The ratio of delta-9 elongation for omegas versus omega-3 substrates ("ratio [LA/ALA] % Elong") was obtained by dividing the LA % delta-9 elongation by the ALA % delta-9 elongation.

In summary of FIG. 20, the *Euglena gracilis* delta-9 elongase functioned in soybean to convert both LA and ALA to EDA and ERA, respectively. The line with the highest average EDA content (i.e., 1936-6-26) had embryos with an average EDA content of 36.1% and an average ERA content of 6.7%. The highest EDA and ERA content for an individual embryo from this line was 44.0% and 10.5%, respectively. The highest average overall % delta-9 elongation was 67.4% with the highest overall % delta-9 elongation for an individual embryo being 75.7%. When broken down into % delta-9 elongation for the omega-6 and omega-3 substrates, the highest average % delta-9 elongation was 67.3% and 67.1% for LA and ALA, respectively. The highest % delta-9 elongation for an individual embryo was 74.7% and 80.0% for LA and ALA, respectively. In this example, the *Euglena gracilis* delta-9 elongase may have a slight preference for ALA over LA, with the average desaturation ratio ranging from 0.8 to 1.0.

Example 32

Functional Analysis of the *Euglena gracilis* Delta-9 Elongase Co-Expressed with the *Euglena gracilis* Delta-8 Desaturase in Somatic Soybean Embryos Transformed with Soybean Expression Vector pKR920

Individual single, matured, somatic soybean embryos that had been transformed with pKR920 (SEQ ID N9:91) and matured in the model system on SB103 plates as described in Example 30, with hygromycin as selection, were picked into glass GC vials and fatty acid methyl esters were prepared by transesterification and analyzed as described in Example 31.

Individual embryo fatty acid profiles for each event (six embryos each) containing pKR920 were obtained from a total of 48 events. Of the 48 events, 40 events had at least one embryo with greater than 1% C20 fatty acids (sum of EDA, ERA, DGLA and ETA) and 29 of these also had a functional *Euglena gracilis* delta-8 desaturase (at least one embryo with greater than 1% DGLA and/or ETA). The lipid profiles of somatic soybean embryos expressing the *Euglena gracilis* delta-9 elongase and the *Euglena gracilis* delta-8 desaturase for the top 5 events are shown in FIG. 21. Fatty acids are identified as 16:0 (palmitate), 18:0 (stearic acid), 18:1 (oleic acid), LA, ALA, EDA, HGLA, ERA and ETA; and, fatty acid compositions listed in FIG. 21 are expressed as a weight percent (wt. %) of total fatty acids. The activity of the *Euglena gracilis* delta-9 elongase is expressed as percent delta-9 elongation (% Elong), calculated according to the following formula: ([product]/[substrate+product])*100.

More specifically, the combined percent elongation for LA and ALA is shown as "Total delta-9% Elong", determined as: ([EDA+HGLA+ERA+ETA]/[LA+ALA+EDA+HGLA+ERA+ETA])*100. This elongation is also referred to as the overall % elongation. The individual omega-6 delta-9 elongation ("LA % Elong") was calculated as: ([EDA+HGLA]/[LA+EDA+HGLA])*100. Similarly, the individual omega-3 delta-9 elongation ("ALA % Elong") was calculated as: ([ERA+ETA]/[ALA+ERA+ETA])*100. The ratio of delta-9 elongation for omega-6 versus omega-3 substrates ("ratio [LA/ALA] % Elong") was obtained by dividing the LA % delta-9 elongation by the ALA % delta-9 elongation.

In summary of FIG. 21, the *Euglena gracilis* delta-9 elongase functioned in soybean to convert both LA and ALA to EDA and ERA, respectively, and these were further converted to HGLA and ETA, respectively, when the *Euglena gracilis* delta-8 desaturase was functional. The line with the highest average overall % delta-9 elongation (i.e., 1919-6-8) had embryos with an average total C20 fatty acid (EDA+HGLA+ERA+ETA) content of 42.2%. The highest total C20 fatty acid (EDA+HGLA+ERA+ETA) content for an individual embryo from this line was 50.1%. The highest average overall % delta-9 elongation was 65.5% with the highest overall % delta-9 elongation for an individual embryo being 80.8%. When broken down into % delta-9 elongation for the omega-6 and omega-3 substrates, the highest average % delta-9 elongation in this event was 64.7% and 69.3% for LA and ALA, respectively. The highest % delta-9 elongation for an individual embryo in this event was 80.4% and 83.8% for LA and ALA, respectively.

Example 33

Transformation of *Arabidopsis*

Transformed *Arabidopsis* plants were created by whole plant *Agrobacterium* transformation. Binary vector pKR926 (SEQ ID NO:102) was transformed into *Agrobacterium tumefaciens* NTL4 (Luo et al., *Molecular Plant-Microbe Interactions* 14(1):98-103 (2001)) by electroporation. Briefly, 1 µg plasmid DNA was mixed with 100 µL of electrocompetent cells on ice. The cell suspension was transferred to a 100 µL electro oration curette (1 mm gap width) and electro orated using a BIORAD electro orator set to 1 kV, 400Ω and 25 µF. Cells were transferred to 1 mL LB medium and incubated for 2 h at 30° C. Cells were plated onto LB medium containing 50 µg/mL kanamycin. Plates were incubated at 30° C. for 60 h. Recombinant *agrobacterium* cultures (500 mL LB, 50 µg/mL kanamycin) were inoculated from single colonies of transformed *Agrobacterium* cells and grown at 30° C. for 60 h.

Cells were harvested by centrifugation (5000×g, 10 min) and resuspended in 1 L of 5% (W/V) sucrose containing 0.05% (V/V) Silwet L-77 (OSI Specialties, Inc). *Arabidopsis* plants were grown in soil at a density of 10 plants per 100 cm$^2$ pot in metromix 360 soil mixture for 4 weeks (22° C., 16 h light/8 h dark, 100 µE m$^{-2}$s$^{-1}$). At early bolting, *Arabidopsis* plants were dipped into the *Agrobacterium* suspension. Two days later, the same plants were dipped again with the same *Agrobacterium* strain in sucrose/Silwet. Plants were grown for three to four weeks under standard plant growth conditions described above and plant material was harvested and dried for one week at ambient temperatures in paper bags. Seeds were harvested using a 0.425 mm mesh brass sieve.

Cleaned *Arabidopsis* seeds (2 grams, corresponding to about 100,000 seeds) were sterilized by washes in 45 mL of 80% ethanol, 0.01% triton X-100, followed by 45 mL of 30% (V/V) household bleach in water, 0.01% triton X-100 and finally by repeated rinsing in sterile water. Aliquots of 20,000 seeds were transferred to square plates (20×20 cm) containing 150 mL of sterile plant growth medium comprised of 0.5×MS salts, 1.0% (W/V) sucrose, 0.05 MES/KOH (pH 5.8), 200 µg/mL timentin, and 50 µg/mL kanamycin solidified with 10 g/L agar. Homogeneous dispersion of the seed on the medium was facilitated by mixing the aqueous seed suspension with an equal volume of melted plant growth medium. Plates were incubated under standard growth conditions for fourteen days. Kanamycin-resistant seedlings were transferred to soil and grown to maturity as described above. T2 seed was obtained from these individual transformants.

Example 34

Functional Analysis of the *Euglena gracilis* Delta-9 Elongase in *Arabidopsis* Seed Transformed with *Arabidopsis* Expression Vector pKR926

Wild-type *Arabidopsis thaliana* (Columbia ecotype) and a fad3/fae1 double mutant (Smith et al., *Planta* 217:507-516 (2003)) were transformed with pKR926 (SEQ ID NO:102) as described in Example 33 and segregating T2 seed was obtained from a number of individual events for each. Bulk T2 seed lipid profiles for each event were obtained by transesterification with TMSH as described in Example 31 with the following modifications. For each event, a small scoopful of seeds (approximately 25-50 seed each scoopful) was crushed in 50 µL of TMSH in a 1.5 mL eppendorf tube. After shaking in TMSH for 15 min., 400 µL of heptane was added and the tubes were vortexed well, shaken for an additional 15 min and centrifuged at 13,000×g for 1 min. After shaking, the heptane layer was removed into glass GC vials and the fatty acid methyl esters were analyzed as described in Example 31.

Bulk T2 seed fatty acid profiles were obtained for 22 events where wild-type *Arabidopsis* was transformed with pKR926 (SEQ ID NO:102) and for 16 events where the fad3/fae1 mutant was transformed. The lipid profiles of T2 bulk seed seed for the 22 wild-type-transformed events as well as for untransformed wild-type are shown in FIG. 22. The lipid profiles of T2 bulk seed for the 16 fad3/fae1-transformed events as well as for untransformed fad3/fae1 are shown in FIG. 23. Fatty acids are identified as 16:0 (palmitate), 18:0 (stearic acid), 18:1 (oleic acid), LA, ALA, 20:0 (arachidic acid), 20:1 (eicosenoic acid), EDA and ERA; and, fatty acid compositions listed in FIG. 22 and FIG. 23 are expressed as a weight percent (wt. %) of total fatty acids.

Individual T2 seed lipid profiles (ten seed per event) for one representative wild-type- and fad3/fae1-transformed event each (i.e., wt pKR926-8 and ff pKR926-1) were obtained by transesterification with TMSH as described in Example 31 with the following modifications. For each event, one seed was crushed in 10 µL of TMSH in a 1.5 mL eppendorf tube. After shaking in TMSH for 15 min, 75 µL of heptane was added and the tubes were vortexed well, shaken for an additional 15 min and centrifuged at 13,000×g for 1 min. After centrifugation, the heptane layer was removed into glass GC vials containing 200 µL inserts and the fatty acid methyl esters were analyzed as described in Example 31. In addition to having a representative T2 bulk seed fatty acid profile, each event chosen for single seed analysis also segregated both for resistance to kanamycin and for phenotype as a single loci insertion (i.e., 3:1).

The lipid profiles for ten single seeds for wt pKR926-8 and ff pKR926-1 are shown in FIG. 24. The activity of the *Euglena gracilis* delta-9 elongase is expressed as percent delta-9 elongation (% Elong), calculated according to the following formula: ([product]/[substrate+product])*100 as described in Example 31. Since the seed are T2 and are segregating, some of the seed have a wt or ff phenotype, respectively and these are indicated with shading (rows 1, 7-8, 12, 16-17 and 20).

Example 35

Co-Expression of the *Euglena gracilis* Delta-9 Elongase with the *Euglena gracilis* Delta-8 Desaturase, the *Mortierella alpina* Delta-5 Desaturase, the *Saprolegnia diclina* Delta-17 Desaturase and the *Fusarium moniliforme* Delta-15 Desaturase in Soybean Embryos Transformed with Soybean Expression Vectors pKR916 and pKR873

Soybean embryogenic suspension culture (cv. Jack) was transformed with the AscI fragments of pKR916 (SEQ ID NO:104; FIG. 19) and pKR873 (SEQ ID NO:56; FIG. 12) (fragments containing the expression cassettes), as described for production in Example 30. A subset of soybean embryos generated from each event (ten embryos per event) were harvested and analyzed for fatty acid composition as described in Example 31. Fatty acids were identified by comparison of retention times to those for authentic standards.

In this way, 169 events transformed with pKR916 and pKR873 were analyzed. From the 169 events analyzed, 127 were identified that produced EPA in at least one embryo out of ten analyzed at a relative abundance greater than 1.0% of the total fatty acids. Of these, 49 were identified that produced EPA in at least one embryo out of ten analyzed at a relative abundance greater than 10.0% of the total fatty acids. The average fatty acid profile for the ten best EPA events (average of nine or ten individual embryos) is shown in FIG. 25A. Fatty acids are identified as 16:0 (palmitate), 18:0 (stearic acid), 18:1 (oleic acid), LA, GLA, ALA, EDA, HGLA, ARA, ERA, JUN, ETA, EPA and DPA; and, fatty acid compositions listed in FIG. 25A are expressed as a weight percent (wt. %) of total fatty acids. For FIG. 25A, fatty acids listed as "others" include: 18:2 (5,9), STA, 20:0, 20:1(11); 20:2 (7,11) or 20:2 (8,11) and 20:3 (5,11,14). Each of these fatty acids is present at a relative abundance of less than 1% of the total fatty acids. The activity of the *Euglena gracilis* delta-9 elongase is expressed as percent delta-9 elongation (% Elong), calculated according to the following formula: ([product]/[substrate+product])*100.

More specifically, the combined percent elongation for LA and ALA is shown as "Total delta-9% Elong", determined as: ([EDA+HGLA+ARA+ERA+JUN+ETA+EPA+DPA]/[LA+ALA+EDA+HGLA+ARA+ERA+JUN+ETA+EPA+DPA])*100. This elongation is also referred to as the overall % elongation.

In summary of FIG. 25A, the *Euglena gracilis* delta-9 elongase functioned in soybean to convert both LA and ALA to EDA and ERA, respectively and these were further converted to other LC-PUFAs. The high EPA line with the highest average overall % delta-9 elongation (i.e., AFS 4697-7-5) had embryos with an average total C20 fatty acid (EDA+HGLA+ARA+ERA+JUN+ETA+EPA+DPA) content of 38.2%. The highest total C20 fatty acid (EDA+HGLA+ARA+ERA+JUN+ETA+EPA+DPA) content for a high EPA individual embryo was 51.4% (embryo from AFS 4709-8-6) and in this embryo, EPA was 24.4%.

Four plants each from top EPA events were regenerated and grown as described in Example 30. Seeds were harvested and a small chip was taken from part of each seed (from directly opposite the embryonic axis) using a razor blade. The seed chips were analyzed for fatty acids as described above. Fatty acid profiles for five seeds with highest EPA from 2 representative events (4697-61 and 6697-6-5) as well for a segregating wild-type seed for each are shown in FIG. 25B. Seed names are designated by a five number series separated by hyphens where the first three numbers indicate a particular event, the fourth number indicates the plant and the fifth number indicates the seed analyzed.

The seed with the highest total C20 fatty acid (EDA+HGLA+ARA+ERA+JUN+ETA+EPA+DPA) content for a high EPA event had total C20 fatty acids of 48.0% (seed number 46976-5-2-4) with a overall % elongation of 77.1% and in this seed, EPA was 16.2%.

Example 36

Construction and Functional Analysis of *Yarrowia lipolytica* Expression Vector pZuFmEgD9ES, Comprising a Synthetic Delta-9 Elongase Gene (Derived from *Euglena gracilis*), Codon-Optimized for Expression in *Yarrowia lipolytica* (EgD9eS)

The present Example describes the expression of *Yarrowia lipolytica* vector pZuFmEgD9ES, comprising a chimeric FBAINm::EgD9ES::Pex20 gene, wherein EgD9eS is a synthetic delta-9 elongase derived from *Euglena gracilis* and codon-optimized for expression in *Yarrowia*. This analysis included: (1) synthesis of EgD9eS; (2) construction and transformation of pZuFmEgD9ES into *Yarrowia lipolytica* strain Y2224; and (3) analysis of lipid profiles within transformant organisms of *Yarrowia lipolytica* strain Y2224 that were comprising pZuFmEgD9ES (expressing EgD9eS).

Synthesis of EgD9eS

The codon usage of the delta-9 elongase gene of *Euglena gracilis* (EgD9e; SEQ ID NOs:4 and 5) was optimized for expression in *Yarrowia lipolytica*, in a manner similar to that described in Example 4 and PCT Publication No. WO 2004/101753. Specifically, a codon-optimized delta-9 elongase gene (designated "EgD9eS"; SEQ ID NO:90) was designed, based on the coding sequence of EgD9e (i.e., from clone eeg1c.pk001.n5.f), according to the *Yarrowia* codon usage pattern (PCT Publication No. WO 2004/101753), the consensus sequence around the 'ATG' translation initiation codon, and the general rules of RNA stability (Guhaniyogi et al., *Gene*, 265(1-2):11-23 (2001)). In addition to modification of the translation initiation site, 117 bp of the 777 bp coding region were modified (15.1%) and 106 codons were optimized (40.9%). FIGS. 26A and B show a comparison of the nucleotide sequences of EgD9e and EgD9eS. None of the modifications in the codon-optimized gene changed the amino acid sequence of the encoded protein (SEQ ID NO:5). The designed EgD9eS gene was synthesized by GenScript Corporation (Piscataway, N.J.) and cloned into pUC57 (GenBank Accession No. Y14837) to generate pEgD9S.

Generation of Construct pZuFmEgD9E (Comprising EgD9E) and pZuFmEgD9ES (Comprising EgD9ES)

Plasmid pZuFmEgD9ES (SEQ-ID NO:105), comprising a chimeric FBAINm::EgD9ES::Pex20 gene, was constructed by replacing the NcoI/NotI fragment of pZUF17 (SEQ ID NO:25) with the NcoI/NotI fragment from pEgD9S comprising EgD9eS. The product of this ligation was auto-replicating expression vector pZuFmEgD9ES, which thereby contained the following components:

TABLE 7

Components of Plasmid pZuFmEgD9ES (SEQ ID NO: 105)

| RE Sites and Nucleotides Within SEQ ID NO: 105 | Description of Fragment and Chimeric Gene Components |
|---|---|
| Swa I/BsiW I (6067-318) | FBAINm::EgD9eS::Pex20, comprising: FBAINm: *Yarrowia lipolytica* FBAINm promoter (WO 2005/049805) EgD9eS: codon-optimized delta-9 elongase (SEQ ID NO: 5, described herein as EgD9eS), derived from *Euglena gracilis* Pex20: Pex20 terminator sequence of *Yarrowia* Pex20 gene (GenBank Accession No. AF054613) |
| 1354-474 | ColE1 plasmid origin of replication |
| 2284-1424 | Ampicillin-resistance gene (Amp$^R$) for selection in *E. coli* |
| 3183-4487 | *Yarrowia* autonomous replication sequence (ARS18; GenBank Accession No. A17608) |
| 6020-4533 | *Yarrowia* Ura 3 gene (GenBank Accession No. AJ306421) |

Plasmid pZuFmEgD9E (SEQ ID NO:106), comprising a chimeric FBAINm::EgD9E::Pex20 gene, was synthesized in a similar manner using the pZUF17 plasmid backbone.

Functional Analysis of *Yarrowia lipolytica* Transformants Comprising pZuFmEgD9E and pZuFmEgD9ES Plasmid pZuFmEgD9E and pZuFmEgD9ES (comprising a chimeric FBAINm::EgD9e::Pex20 gene and FBAINm::EgD9eS::Pex20 gene, respectively) were transformed into strain Y2224 (the FOA resistant mutant from an autonomous mutation of the Ura3 gene of wildtype *Yarrowia* strain ATCC #20362; Example 21), as described in the General Methods. The transformants were selected on MM plates. After 2 days growth at 30° C., 3 transformants grown on the MM plates were picked and re-streaked onto fresh MM plates. Once grown, these strains were individually inoculated into 3 mL liquid MM at 30° C. and shaken at 250 rpm/min for 2 days. The cells were collected by centrifugation, lipids were extracted, and fatty acid methyl esters were prepared by transesterification, and subsequently analyzed with a Hewlett-Packard 6890 GC.

GC analyses showed that there were about 3.2% EDA (C20:2) of total lipids produced in all seven transformants with pZuFmEgD9E, wherein the average conversion efficiency of LA (C18:2) to EDA in these seven strains was determined to be about 18.3% (average; calculated as described in Example 20).

In contrast, GC analyses showed that there were about 3.6% EDA (C20:2) of total lipids produced in all seven transformants with pZuFmEgD9ES, wherein the average conversion efficiency of LA (C18:2) to EDA in these seven strains was determined to be about 20.1% (average). Thus, the experimental data demonstrated that the synthetic *Euglena gracilis* delta-9 elongase codon-optimized for expression in *Yarrowia lipolytica* (i.e., EgD9eS; SEQ ID NO:90) was about 16.2% more efficient elongating LA to EDA than the wild-type EgD9e gene (i.e., SEQ ID NO:4).

Example 37

Preparation of *Eutreptiella* sp. CCMP389 Genomic DNA, RNA and cDNA

The present Example describes the preparation of genomic DNA, RNA and cDNA from *Eutreptiella* sp. CCMP389, which had been purchased from The Provasoli-Guillard National Center for Culture of Marine Phytoplankton (CCMP) (Bigelow Laboratory for Ocean Sciences, West Boothbay Harbor, Me.).

Preparation of RNA and Genomic DNA from *Eutreptiella* sp. CCMP389

Total RNA and genomic DNA Were isolated from 1 liter of culture using Trizol reagent (Invitrogen, Carlsbad, Calif.), according to the manufacturers protocol. Specifically, the cell pellet was resuspended in 0.75 mL of Trizol reagent, mixed with 0.5 mL of 0.5 mm glass beads, and homogenized in a Biospec mini beadbeater (Bartlesville, Okla.) at the highest setting for 3 min. The mixtures were centrifuged in an Eppendorf centrifuge for 30 sec at 14,000 rpm to remove debris and glass beads. The supernatant was extracted with 150 µL of 24:1 chloroform:isoamyl alcohol (Invitrogen). The upper aqueous phase was used for RNA isolation and the lower organic phase was used for DNA isolation.

For RNA isolation, the aqueous phase was mixed with 0.375 mL of isopropyl alcohol and allowed to incubate at room temperature for 5 min. Precipitated RNA was collected by centrifugation at 8,000 rpm and 4° C. for 5 min. The pellet was washed once with 0.7 mL of 80% ethanol and air-dried. In this way, 360 µg of total RNA were obtained.

For genomic DNA isolation, the lower organic phase was mixed with 75 µL of ethanol and incubated at room temperature for 5 min. The sample was then centrifuged at 5,000 rpm for 2 min in an Eppendorf centrifuge. The pellet was washed with 0.75 mL of 0.1 M sodium citrate:10% ethanol twice. Each time, the sample was incubated for 15 min at room temperature in the wash solution, followed by centrifugation at 5,000 rpm for 5 min at 4° C. The pellet was air-dried and re-dissolved in 300 µL of 8 mM NaOH. The pH of the sample was adjusted to 7.5 with 1 M HEPES. The genomic DNA was then further purified with a Qiagen PCR purification kit (Valencia, Calif.) exactly as described in the manufacturer's protocol. Thus, 40 µg of genomic DNA was isolated.

Preparation of cDNA from *Eutreptiella* sp, CCMP389

Double-stranded cDNA was generated, using the Creator™ SMART™ cDNA Library Construction Kit from BD Bioscience Clontech (Palo Alto, Calif.). Specifically, for first strand cDNA synthesis, 1 μL of the total RNA sample (1.2 μg) was mixed individually with 1 μL of SMART™ IV oligonucleotide (SEQ ID NO:107), 1 μlL CDSIII/3' PCR primer (SEQ ID NO:108) and 2 μL of water. The mixture was heated to 75° C. for 5 min and cooled on ice for 5 min. To the sample was added 2 μL of 5× first strand buffer, 1 μL 20 mM DTT, 1 μL of dNTP mix (10 mM each of dATP, dCTP, dGTP and dTTP) and 1 μL of PowerScript reverse transcriptase. The sample was incubated at 42° C. for 1 hr.

The first strand cDNA synthesis mixture was used as template for amplification. Specifically, the reaction mixture contained 2 μL of the above first strand cDNA sample, 80 μL of water, 10 μL of 10× Advantage 2 PCR buffer, 2 μL 50×dNTP mix (10 mM each of dATP, dCTP, dGTP and dTTP), 2 μL of 5'-PCR primer (SEQ ID NO:109), 2 μL CDSIII/3'-PCR primer (SEQ ID NO:108) and 2 μL 50× Advantage 2 polymerase mix. PCR amplification was performed using the following conditions: 95° C. for 1 min, followed by 20 cycles of 95° C. for 10 sec and 68° C. for 6 min. Amplification products were purified with a Qiagen PCR purification kit following the manufacturer's protocol exactly. Purified products were eluted with 50 μL of water.

Example 38

Isolation of the Full-Length Delta-9 Elongase from *Eutreptiella* sp. CCMP389

The present Example describes the identification of a partial cDNA fragment encoding a delta-9 elongase from *Eutreptiella* sp. CCMP389, by use of primers derived from conserved regions of the *Euglena gracilis* (EgD9e; Example 3) and *Isochrysis galbana* (IgD9e) delta-9 elongase sequences. Then, based on the sequence of the partial cDNA fragment, the 5' and 3' ends of the gene were isolated. This enabled assembly of a contig (SEQ ID NO:111), extending 51 bases upstream of the *Eutreptiella* sp, CCMP389 delta-9 elongase translation initiation 'ATG' codon and 662 bp beyond the delta-9 elongase termination codon.

Identification of a cDNA Fragment Encoding a Partial Delta-9 Elongase from *Eutreptiella* sp. CCMP389

It was assumed that a delta-9 elongase/delta-8 desaturase pathway operated in *Eutreptiella* sp. CCMP389, based on the Applicants' Assignee's previous identification of a delta-8 desaturase within the organism (co-pending U.S. Patent Application No. 60/853,563; filed Oct. 23, 2006. Design of degenerate primers suitable to isolate the *Eutreptiella* sp. CCMP389 delta-9 elongase was based on the identification of several stretches of conserved amino acid sequences common to both EgD9e (SEQ ID NO:5) and IgD9e (SEQ ID NO:27), when an alignment of the two elongases was produced using the method of Clustal W (slow, accurate, Gonnet option; Thompson et al., *Nucleic Acids Res.*, 22:4673-4680 (1994)) of the MegAlign™ program of DNASTAR software (see FIG. 27).

Based on this alignment, the following set of degenerate oligonucleotides were designed to amplify a portion of the coding region of the delta-9 elongase gene from *Eutreptiella* sp. CCMP389, as shown in Table 8.

TABLE 8

Degenerate Oligonucleotides used to Amplify the Delta-9 Elongase Gene From *Eutreptiella* Sp. CCMP389

| Primer | Nucleotide Sequence | Amino Acid Sequence | Position Within SEQ ID NO:2 (EgD9e) |
|---|---|---|---|
| EuEF3 | YTNCARTTYTTYCAYCA YTT (SEQ ID NO:112) | LQFFHHL (SEQ ID NO:113) | 150-156 |
| EuER3 | TTRAAYTGDATDATYTG CAT (SEQ ID NO:114) | MQIIQFN (SEQ ID NO:115) | 210-216 |

[Note: The nucleic acid degeneracy code used for SEQ ID NOs:112 and 114 was as follows: R = A/G; Y = C/T; D = G/A/T; and N = A/C/T/G.]

The reaction mixture contained 1 μL of 1:20 diluted cDNA, 5 μL each of the forward and reverse primers (20 μM), 14 μL water and 25 μL of TaKaRa ExTaq 2× premix (TaKaRa Bio, Mountain View, Calif.). PCR amplification was performed using the following parameters: 94° C. for 1 min, then 35 cycles of 94° C. for 20 sec, 55° C. for 20 sec, and 72° C. for 1 min, followed by a final elongation cycle at 72° C. for 5 min.

Agarose gel analysis of the PCR products showed that a ~200 bp fragment was obtained. The fragments were purified with a Qiagen PCR purification kit, cloned into pCR2.1-TOPO (Invitrogen) and sequenced. The resultant sequence (SEQ ID NO:129), when translated, had homology with the known delta-9 elongase from *Isochrysis galbana* (IgD9e; SEQ ID NO:27), based on BLAST program analysis (Basic Local Alignment Search Tool; Altschul, S. F., et al., *J. Mol. Biol.*, 215:403-410 (1993)).

Isolation of the 5'-End Sequence of the *Eutreptiella sp.* CCMP389 Delta-9 Elongase Double-stranded cDNA of *Eutreptiella* sp. CCMP389 (Example 37) was used as template in two separate rounds of PCR amplification. In the first round of PCR amplification, the oligonucleotide primers consisted of a gene specific oligonucleotide (i.e., 389Elo-5-1 (SEQ ID NO:116)) and the generic oligonucleotide 5'-PCR primer (SEQ ID NO:109) from the BD-Clontech Creator™ SMART™ cDNA Library Kit. The PCR amplifications were carried out in a 50 μL total volume, comprising: 1 μL of 1:10 diluted *Eutreptiella* sp. CCMP389 cDNA as template, 1 μL of each primer (20 μM), 22 μL water and 25 μL TaKaRa ExTaq 2× premix. Amplification was carried out at 94° C. for 90 sec, then 30 cycles of 94° C. for 30 sec, 55° C. for 30 sec and 72° C. for 1 min, followed by a final elongation cycle at 72° C. for 7 min.

The second round of PCR amplification used 1 μL of diluted product (1:50) from the first round PCR reaction as template. Primers consisted of a gene specific oligonucleotide (i.e., 389Elo-5-2 (SEQ ID NO:117)) and the oligonucleotide DNR CDS 5'-2 (SEQ ID NO:118). Amplification was conducted as described above.

The products of the second round PCR reaction were electrophoresed in 1% (w/v) agarose and appeared as a diffused band spanning the size range of 200 to 800 bp. Products between 400 bp to 600 bp were isolated using a Qiagen Gel purification kit according to the manufacturer's protocol, cloned into pCR2.1-TOPO (Invitrogen), and transformed into *E. coli*. Transformants were selected on LB agar containing ampicillin (100 μg/mL).

Sequence analysis of the plasmid DNA from one transformant comprising the 5' region of the putative delta-9 elongase cDNA revealed a fragment of 406 bp (i.e., 5'-cDNA fragment 1; SEQ ID NO:119). This fragment extended to near the gene's 'ATG' translation initiation codon, but neither the start codon nor the first 20 to 30 amino acids were included in SEQ ID NO:119.

An additional oligonucleotide (i.e., 389Elo-5-4 (SEQ ID NO:120)) was then designed to obtain the complete 5' end of the gene by PCR, based on the sequence of 5'-cDNA fragment 1 (SEQ ID NO:119). The reaction mixture and amplification conditions were identical to those used for the second round of PCR above, except that primer 389Elo-5-2 was replaced with 389Elo-5-4. When analyzed by agarose gel electrophoresis, PCR products again appeared as a diffused band between 200 and 800 bp and fragments with a size of 200 to 500 bp were isolated, cloned and transformed as described above.

Sequence analysis of the plasmid DNA from one transformant comprising the 5' region of the putative delta-9 elongase cDNA revealed a fragment of 197 bp (5'-cDNA fragment 2; SEQ ID NO:121). This included the 5'-end of the cDNA and 51 bp of upstream-untranslated region.

Isolation of the 3'-End of the *Eutreptiella* sp. CCMP389 Delta-9 Elongase

The 3' end of the putative delta-9 delta elongase was also isolated by PCR amplification using cDNA as template. The methodology was as described above for isolation of the 5' end; however, the primers used on both the first and second round of PCR amplification were as shown below in Table 9 and were 10 µM instead of 20 µM. Additionally, the final elongation cycle at 72° C. was decreased from 7 min to 5 min.

TABLE 9

Oligonucleotide Primers Used For 3' cDNA Isolation

| PCR Amplification | Gene Specific Oligonucleotide | Generic Oligonucleotide |
|---|---|---|
| 1st Round | 389Elo-3-1 (SEQ ID NO: 122) | CDSIII/3' PCR primer (SEQ ID NO: 108) |
| 2nd Round | 389Elo-3-2 (SEQ ID NO: 123) | CDSIII/3' PCR primer (SEQ ID NO: 108) |

* CDSIII/3' PCR primer was supplied in Clontech's Creator ™ SMART ™ cDNA Library Construction Kit.

A ~1 kB DNA fragment was generated from the 2$^{nd}$ round PCR amplication, which was purified with a Qiagen PCR purification kit, cloned into pCR2.1-TOPO, transformed and sequenced. Sequence analysis of several clones showed that the ~1 kB DNA fragment contained the 3'-region of the putative delta-9 elongase cDNA, including the poly A tail. The 920 bp assembled contig sequence of the 3'-region is shown as SEQ ID NO:124.

Assembly of the Full-Length Delta-9 Elongase Sequence from *Eutreptiella* sp. CCMP389

Assembly of the original partial cDNA fragment (SEQ ID NO:116), the two 5' cDNA fragments (SEQ ID NOs:119 and 121) and 3'-cDNA fragment (SEQ ID NO:124) resulted in the complete sequence of the delta-9 elongase from *Eutreptiella* sp. CCMP389, plus 51 bp of 5' untranslated region and 662 bp of 3' untranslated region (SEQ ID NO:125; 1504 bp). The coding region is 792 bp long and encodes a protein of 263 amino acids (SEQ ID NO:126). SEQ ID NO:127 is the nucleotide sequence of the coding sequence of *Eutreptiella* sp. CCMP389 delta-9 elongase (designated herein as E389D9e).

Comparison of the Delta-9 Elongase Sequence of *Eutreptiella* sp. CCMP389 (E389D9e) to Known Delta-9 Elongases Identity of SEQ ID NO:127 (i.e., E389D9e) was determined by conducting BLAST searches for similarity to sequences contained in the BLAST "nr" database (Example 3). The results of the BLAST comparison summarizing the sequence to which SEQ ID NO:127 has the most similarity are reported according to the % identity, % similarity, and Expectation value. "% Identity" is defined as the percentage of amino acids that are identical between the two proteins. "% Similarity" is defined as the percentage of amino acids that are identical or conserved between the two proteins. "Expectation value" estimates the statistical significance of the match, specifying the number of matches, with a given score, that are expected in a search of a database of this size absolutely by chance.

Thus, the amino acid fragment described herein as SEQ ID NO:126 shared 38% identity and 56% similarity with IgD9e, the delta-9 elongase of *Isochrysis galbana* (SEQ ID NO:27), with an expectation value of 2E43. Similarly, E389D9e is 33.1% identical to IgD9e using the Clustal V method and E389D9e is 65.1% identical to EgD9e using the Clustal V method (see FIG. 29). Sequence percent identity calculations performed by the Clustal V method (Higgins, D. G. and Sharp, P. M., *Comput. Appl. Biosci.*, 5:151-153 (1989); Higgins et al., *Comput. Appl. Biosci.*, 8:189-191 (1992)) were done using the MegAlign™ v6.1 program of the LASERGENE bioinformatics computing suite with the default parameters for pairwise alignment (KTUPLE=1, GAP PENALTY=3, WINDOW=5, DIAGONALS SAVED=5 and GAP LENGTH PENALTY=10).

Additionally, pairwise alignment of SEQ ID NO:126 to the EgD9e sequence of SEQ ID NO:5 using default parameters of Vector NTI®'s AlignX program revealed 65% identity and 76.5% similarity between the two proteins over a length of the 258 amino acids of EgD9e.

Example 39

Construction and Functional Analysis of *Yarrowia lipolytica* Expression Vector pFBAIN-389Elo (Comprising the *Eutreptiella* sp. CCMP389 Delta-9 Elongase (E389D9e)) in *Yarrowia lipolytica* Strain Y2224)

The present Example describes synthesis of *Yarrowia lipolytica* expression vector pFBAIN-389Elo (comprising a chimeric FBAINm::E389D9e::Pex20 gene). Delta-9 elongase activity of E389D9e when expressed in *Yarrowia lipolytica* strain Y2224 was subsequently determined.

Construction of *Yarrowia lipolytica* Expression Vector pFBAIN-389Elo

Oligonucleotides 389Elo-F and 389Elo-R1 (SEQ ID NOs: 116 and 117, respectively) were used as primers to amplify the full length cDNA of E389D9e (SEQ ID NO:127). The PCR reactions, with *Eutreptiella* sp. CCMP389 cDNA (Example 27) as template, were individually carried out in a 50 µL total volume comprising: 1 µL each of 20 µM forward and reverse primers, 1 µL cDNA, 10 µL 5×PCR buffer, 1 µL dNTP mix (10 µM each), 35 µL water and 1 µL Phusion polymerase (New England Biolabs, Inc., Ipswich, Mass.). Amplification was carried out at 98° C. for 1 min, then 30 cycles of 98° C. for 10 sec, 55° C. for 10 sec, and 72° C. for 30 sec, followed by a final elongation cycle at 72° C. for 5 min. The PCR product was digested with NcoI and EarI to generate a ~210 bp fragment that contained the 5' region of the delta-9 elongase cDNA. It was also digested with EarI and NotI to generate a ~600 bp fragment that contained the 3' region of the cDNA. The NcoI/EarI and the EarI/NotI digested fragments were purified following gel electrophoresis in 1% (w/v) agarose.

The NcoI/EarI and the EarI/NotI delta-9 elongase digested fragments were directionally ligated with NcoI/NotI digested pFBAIN-MOD-1 (SEQ ID NO:128), such that the E389D9e gene was under the control of the *Yarrowia lipolytica* FBAINm promoter and the PEX20-3' terminator region. Specifically, the ligation reaction contained: 10 µL 2× ligation buffer, 1 µL T4 DNA ligase (Promega), 4 µL each of the ~210 bp and the ~600 bp fragment (~300 ng each), and 1 µL pFBAIN-MOD-1 (~150 ng). The reaction mixture was incubated at room temperature for 2 h and used to transform *E. coli* Top10 competent cells (Invitrogen). Plasmid DNA from transformants was recovered using a Qiagen Miniprep kit. Correct clones were identified by restriction mapping and the final construct was designated "pFBAIN-389Elo".

Thus, pFBAIN-389Elo (FIG. 28; SEQ ID NO:110) thereby contained the following components:

TABLE 10

| Components of Plasmid pFBAIN-389Elo (SEQ ID NO: 110) | |
|---|---|
| RE Sites and Nucleotides Within SEQ ID NO: 110 | Description of Fragment and Chimeric Gene Components |
| BglII-BsiWI (6040-301) | FBAINm::E389D9e::Pex20, comprising: FBAINm: *Yarrowia lipolytica* FBAINm promoter (PCT Publication No. WO 2005/049805) E389D9e: *Eutreptiella* sp. CCMP389 delta-9 elongase (SEQ ID NO: 127 described herein) Pex20: Pex20 terminator sequence of *Yarrowia* Pex20 gene (GenBank Accession No. AF054613) |
| PacI-BglII (4533-6040) | *Yarrowia* Ura 3 gene (GenBank Accession No. AJ306421) |
| (3123-4487) | *Yarrowia* autonomous replication sequence (ARS18; GenBank Accession No. A17608) |
| (2464-2864) | f1 origin |
| (1424-2284) | Ampicillin-resistance gene ($Amp^R$) for selection in *E. coli* |
| (474-1354) | ColE1 plasmid origin of replication |

Functional Analysis of *Yarrowia lipolytica* Transformants Comprising pFBAIN-389Elo Five (5) individual clones of pFBAIN-389Elo (comprising E389D9e) and control plasmid pFBAIN-MOD-1 were transformed into *Yarrowia lipolytica* strain Y2224 (Example 20) as described in the General Methods. The cells were plated onto MM plates lacking uracil and maintained at 30° C. for 2 to 3 days. Then, cells from each plate were scraped off, lipids were extracted, and fatty acid methyl esters were prepared by transesterification, and subsequently analyzed with a Hewlett-Packard 6890 GC.

GC analyses showed that EDA was produced in all five of the transformants comprising pFBAIN-389Elo, while no EDA was produced in the control strain (Table 11). Fatty acids are identified as 18:2 (LA) and 20:2 (EDA); and the composition of each is presented as a % of the total fatty acids. The conversion efficiency was calculated according to the following formula: ([product]/[substrate+product])*100, where 'product' includes the immediate product and all products in the pathway derived from it.

TABLE 11

Lipid Composition in *Yarrowia lipolytica* Strain Y2224 Engineered to Over-Express *Eutreptiella* sp. CCMP389 Delta-9 Elongase (E389D9e)

| Plasmid | Clone | C18:2 | C20:2 | Conversion Efficiency |
|---|---|---|---|---|
| pFBAIN-MOD-1 | 1 | 17.4 | 0 | 0 |
| pFBAIN-389Elo | 1 | 13.49 | 2.16 | 13.80 |
| | 2 | 13.16 | 1.79 | 11.97 |
| | 3 | 14.11 | 1.92 | 11.98 |
| | 4 | 15.55 | 0.78 | 4.78 |
| | 5 | 13.24 | 1.79 | 11.91 |

The results shown above confirmed that the cloned cDNA from *Eutreptiella* sp. CCMP389, described herein as SEQ ID NOs:126 and 127, efficiently desaturated LA to EDA and thus functioned as a delta-9 elongase.

Example 40

Construction of Alternate Soybean Expression Vectors for Expression of Other PUFA Genes In addition to the genes, promoters, terminators and gene cassettes described herein, one skilled in the art can appreciate that other promoter/gene/terminator cassette combinations can be synthesized in a way similar to, but not limited to, that described herein for expression of EgD9e, EgD9eS, E389D9e or E389D9eS. Similarly, it may be desirable to express other PUFA genes (such as those described below in Table 14), for co-expression with any of the delta-9 elongases of the present invention.

For instance, PCT Publication Nos. WO 2004/071467 and WO 2004/071178 describe the isolation of a number of promoter and transcription terminator sequences for use in embryo-specific expression in soybean. Furthermore, PCT Publication Nos. WO 2004/071467, WO 2005/047479 and WO 2006/012325 describe the synthesis of multiple promoter/gene/terminator cassette combinations by ligating individual promoters, genes and transcription terminators together in unique combinations. Generally, a NotI site flanked by the suitable promoter (such as those listed in, but not limited to, Table 12) and a transcription terminator (such as those listed in, but not limited to, Table 13) is used to clone the desired gene. NotI sites can be added to a gene of interest such as those listed in, but not limited to, Table 14 using PCR amplification with oligonucleotides designed to introduce NotI sites at the 5' and 3' ends of the gene. The resulting PCR product is then digested with NotI and cloned into a suitable promoter/NotI/terminator cassette.

In addition, PCT Publication Nos. WO 2004/071467, WO 2005/047479 and WO 2006/012325 describe the further linking together of individual gene cassettes in unique combinations, along with suitable selectable marker cassettes, in order to obtain the desired phenotypic expression. Although this is done mainly using different restriction enzymes sites, one skilled in the art can appreciate that a number of techniques can be utilized to achieve the desired promoter/gene/transcription terminator combination. In so doing, any combination of embryo-specific promoter/gene/transcription terminator cassettes can be achieved. One skilled in the art can also appreciate that these cassettes can be located on individual DNA fragments or on multiple fragments where co-expression of genes is the outcome of co-transformation of multiple DNA fragments.

TABLE 12

Seed-specific Promoters

| Promoter | Organism | Promoter Reference |
|---|---|---|
| β-conglycinin α'-subunit | soybean | Beachy et al., EMBO J. 4: 3047-3053 (1985) |
| kunitz trypsin inhibitor | soybean | Jofuku et al., Plant Cell 1: 1079-1093 (1989) |
| annexin | soybean | WO 2004/071467 |
| glycinin Gy1 | soybean | WO 2004/071467 |
| albumin 2S | soybean | U.S. Pat. No. 6,177,613 |
| legumin A1 | pea | Rerie et al., Mol. Gen. Genet. 225: 148-157 (1991) |
| β-conglycinin β-subunit | soybean | WO 2004/071467 |
| BD30 (also called P34) | soybean | WO 2004/071467 |
| legumin A2 | pea | Rerie et al., Mol. Gen. Genet. 225: 148-157 (1991) |

TABLE 13

Transcription Terminators

| Transcription Terminator | Organism | Reference |
|---|---|---|
| phaseolin 3' | bean | WO 2004/071467 |
| kunitz trypsin inhibitor 3' | soybean | WO 2004/071467 |
| BD30 (also called P34) 3' | soybean | WO 2004/071467 |
| legumin A2 3' | pea | WO 2004/071467 |
| albumin 2S 3' | soybean | WO 2004/071467 |

TABLE 14

PUFA Biosynthetic Pathway Genes

| Gene | Organism | Reference |
|---|---|---|
| delta-6 desaturase | *Saprolegnia diclina* | WO 2002/081668 |
| delta-6 desaturase | *Mortierella alpina* | U.S. Pat. No. 5,968,809 |
| elongase | *Mortierella alpina* | WO 2000/12720 U.S. Pat. No. 6,403,349 |
| delta-5 desaturase | *Mortierella alpina* | U.S. Pat. No. 6,075,183 |
| delta-5 desaturase | *Saprolegnia diclina* | WO 2002/081668 |
| delta-15 desaturase | *Fusarium moniliforme* | WO 2005/047479 |
| delta-17 desaturase | *Saprolegnia diclina* | WO 2002/081668 |
| elongase | *Thraustochytrium aureum* | WO 2002/08401 U.S. Pat. No. 6,677,145 |
| elongase | *Pavlova* sp. | Pereira et al., Biochem. J. 384: 357-366 (2004) |
| delta-4 desaturase | *Schizochytrium aggregatum* | WO 2002/090493 |
| delta-9 elongase | *Isochrysis galbana* | WO 2002/077213 |
| delta-9 elongase | *Euglena gracilis* | U.S. Provisional Application No. 60/739,989 |
| delta-8 desaturase | *Euglena gracilis* | WO 2000/34439 U.S. Pat. No. 6,825,017 WO 2004/057001 WO 2006/012325 |
| delta-8 desaturase | *Acanthamoeba castellanii* | Sayanova et al., FEBS Lett. 580: 1946-1952 (2006) |
| delta-8 desaturase | *Pavlova salina* | WO 2005/103253 |
| delta-8 desaturase | *Pavlova lutheri* | U.S. Provisional Application No. 60/795,810 |
| delta-8 desaturase | *Tetruetreptia pomquetensis* CCMP1491 | U.S. Provisional Application No. 60/853,563 |
| delta-8 desaturase | *Eutreptiella* sp. CCMP389 | U.S. Provisional Application No. 60/853,563 |
| delta-8 desaturase | *Eutreptiella* cf *gymnastica* CCMP1594 | U.S. Provisional Application No. 60/853,563 |

SEQUENCE LISTING (136 sequences)

SEQ ID NO: 1 - DNA, 757 bp, Euglena gracilis
  misc_feature (677)..(677): n is a, c, g, or t
ttttttttcgaacacttaatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgangatgtttggctggttcttcaattacttttatgttggcacagtcttgtgtttgttcttgaatttctatgtgcaaacgtata

SEQ ID NO: 2 - DNA, 774 bp, Euglena gracilis
  misc_feature (34)..(34): n is a, c, g, or t
  misc_feature (69)..(69): n is a, c, g, or t
  misc_feature (82)..(82): n is a, c, g, or t
  misc_feature (112)..(112): n is a, c, g, or t
  misc_feature (218)..(220): n is a, c, g, or t
  misc_feature (707)..(709): n is a, c, g, or t
  misc_feature (711)..(711): n is a, c, g, or t
tcaggatcaccacgcagttgttctatttgagcangttcctggagtatattgactccttctatttgccantgatgggcaagcntctgacctggttgcaattcttccatcattngggggcaccgatggatatgtggctgttctataattaccgaaatgaagctgtttggatttttgtgctgttgaatggtttcatccactggatcatgtacggttattannngaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgatatttcctcctctgcggtggcctcttttgacctccccttgacacctataatgtggaggtgtcgggctctctccgtctcaccagcacttgactctgcaggtgctcacttttattttttacccatctttgcttgttgaccattcacctctcccacttccacatagtccattctaactgttgcagactgcggtccattttttccagagctcccaatgaccatacgcgacaccttgtnnncncccagcccattgtgcacaattcatagtggcatcgttttgccttgatacgtgtgcatccagcgg

SEQ ID NO: 3 - DNA, 1201 bp, Euglena gracilis
  misc_feature (1134)..(1136): n is a, c, g, or t
  misc_feature (1138)..(1138): n is a, c, g, or t
gacatggcaactatgattttattttgactgatagtgacctgttcgttgcaacaaattgatgagcaatgcttttttataatgccaactttgtacaaaaaagttggattttttttcgaacacttaatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgatatttcctcctctgcggtggcctcttttgacctccccttgacacctataatgtggaggtgtcgggctctctccgtctcaccagcacttgactctgcaggtgctcacttttattttttacccatctttgcttgttgaccattcacctctcccacttccacatagtccattctaactgttgcagactgcggtccattttttccagagctcccaatgaccatacgcgacaccttgtnnncncccagcccattgtgcacaattcatagtggcatcgttttgccttgatacgtgtgcatccagcgg

SEQ ID NO: 4 - DNA, 777 bp, Euglena gracilis
atggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtga

SEQ ID NO: 5 - protein, 258 aa, Euglena gracilis
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 6 - DNA, 31 bp, Artificial Sequence
  sequence of the ig-s primer
caccatggctctggccaacgacgctggcgag

SEQ ID NO: 7 - DNA, 26 bp, Artificial Sequence
  sequence of the ig-as primer
ctaaagctgcttaccagccttagcgg

SEQ ID NO: 8 - DNA, 30 bp, Artificial Sequence
  sequence of the oEugEL1-1 primer
agcggccgcaccatggaggtggtgaatgaa

SEQ ID NO: 9 - DNA, 30 bp, Artificial Sequence
  sequence of the oEugEL1-2 primer
tgcggccgctcactgaatctttttggctcc

SEQ ID NO: 10 - DNA, 19 bp, Artificial Sequence
  sequence of the Eg5-1 primer
gaaatgaagtcaaagcgcc

SEQ ID NO: 11 - DNA, 19 bp, Artificial Sequence
  sequence of the Eg3-3 primer
ccttatagagccttccccg

SEQ ID NO: 12 - DNA, 19 bp, Artificial Sequence
  sequence of T7
ggaaacagctatgaccatg

SEQ ID NO: 13 - DNA, 22 bp, Artificial Sequence
  sequence of M13-28Rev
gtaatacgactcactatagggc

SEQ ID NO: 14 - DNA, 19 bp, Artificial Sequence
  sequence of Eg3-2
aatgttcatggtctcatgg

SEQ ID NO: 15 - DNA, 19 bp, Artificial Sequence
  sequence of Eg5-2
ttggcaatggtctgcaagg

SEQ ID NO: 16 - DNA, 1266 bp, Euglena gracilis
atgaagtcaaagcgccaagcgcttccccttacaattgatggaacaacatatgatgtgtctgcctgggtcaatttccaccctggtggtgcggaaattatagagaattaccaaggaagggatgccactgatgccttcatggttatgcactctcaagaagccttcgacaagctcaagcgcatgcccaaaatcaatcccagttctgagttgccaccccaggctgcagtgaatgaagctcaagaggatttccggaagctccgagaagagttgatcgcaactggcatgtttgatgcctcccccctctggtactcatacaaaatcagcaccacactgggccttggagtgctgggttatttcctgatggttcagtatcagatgtatttcattggggcagtgttgcttgggatgcactatcaacagatgggctggctttctcatgacatttgccaccaccagactttcaagaaccggaactggaacaacctcgtgggactggtatttggcaatggtctgcaaggtttttccgtgacatggtggaaggacagacacaatgcacatcattcggcaaccaatgttcaagggcacgaccctgatattgacaacctccccctcttagcctggtctgaggatgacgtcacacgggcgtcaccgatttcccgcaagctcattcagttccagcagtactatttcttggtcatctgtatcttgttgcggttcatttggtgtttccagagcgtgttgaccgtgcgcagtttgaaggacagagataaccaattctatcgctctcagtataagaaggaggccattggcctcgccctgcactggaccttgaagaccctgttccacttattctttatgcccagcatcctcacatcgctgttggtgtttttcgtttcggagctggttggcggcttcggcattgcgatcgtggtgttcatgaaccactacccactggagaagatcggggactcagtctgggatggccatggattctcggttggccagatccatgagaccatgaacattcggcgagggattatcacagattggtttttcggaggcttgaattaccagattgagcaccatttgtggccgaccctccctcgccacaacctgacagcggttagctaccaggtggaacagctgtgccagaagcacaacctgccgtatcggaacccgctgccccatgaagggttggtcatcctgctgcgctatctggcggtgttcgcccggatggcggagaagcaacccgcggggaaggctctataa

SEQ ID NO: 17 - protein, 421 aa, Euglena gracilis
MKSKRQALPLTIDGTTYDVSAWVNFHPGGAEIIENYQGRDATDAFMVMHSQEAFDKLKRMPKINPSSELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSLLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 18 - DNA, 37 bp, Artificial Sequence
  sequence of the Kti cassette 5' end MCS for pKR457
aagcttgcatgcctgcaggtcgactcgacgtacgtcc

SEQ ID NO: 19 - DNA, 282 bp, Artificial Sequence
  sequence of the Kti cassette 3' end MCS for pKR457 including the soy albumin transcription 3' terminator
ggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtgggcggatcc

SEQ ID NO: 20 - DNA, 32 bp, Artificial Sequence
  sequence of the oSalb-12 primer
tttggatcctctagacgtacgcaaaggcaaag

SEQ ID NO: 21 - DNA, 36 bp, Artificial Sequence
  sequence of the oSalb-13 primer
aaaggatccaaggccgcgaagttaaaagcaatgttg

SEQ ID NO: 22 - DNA, 69 bp, Artificial Sequence
  sequence of restriction sites added to pKR287 to make pKR767
ccatggtcaatcaatgagacgccaacttcttaatctattgagacctgcaggtctagaagggcggatccc

SEQ ID NO: 23 - DNA, 33 bp, Artificial Sequence
  sequence of the oSAlb-9 primer
ttctagacgtacgaaaccaactgcgtttggggc

SEQ ID NO: 24 - DNA, 35 bp, Artificial Sequence
  sequence of the oSAlb-2 primer
aatctagacgtacgcaaaggcaaagatttaaactc

SEQ ID NO: 25 - DNA, 8165 bp, Artificial Sequence
  sequence of pZUF17
gtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctgaggataagaccaaggtcgagttccctaccctgactgagctgaagcactctatccctaacgcttgctttgagtccaacctcggactctcgctctactacactgcccgagcgatcttcaacgcatctgcctctgctgctctgctctacgctgcccgatctactcccttcattgccgataacgttctgctccacgctctggtttgcgccacctacatctacgtgcagggtgtcatcttctggggtttctttaccgtcggtcacgactgtggtcactctgccttctcccgataccactccgtcaacttcatcattggctgcatcatgcactctgccattctgactcccttcgagtcctggcgagtgacccaccgacaccatcacaagaacactggcaacattgataaggacgagatcttctaccctcatcggtccgtcaaggacctccaggacgtgcgacaatgggtctacaccctcggaggtgcttggtttgtctacctgaaggtcggatatgctcctcgaaccatgtcccactttgacccctgggaccctctcctgcttcgacgagcctccgctgtcatcgtgtccctcggagtctgggctgccttcttcgctgcctacgcctacctcacatactcgctcggctttgccgtcatgggcctctactactatgctcctctctttgtctttgcttcgttcctcgtcattactaccttcttgcatcacaacgacgaagctactccctggtacggtgactcggagtggacctacgtcaagggcaacctgagctccgtcgaccgatcgtacggagctttcgtggacaacctgtctcaccacattggcacccaccaggtccatcacttgttccctatcattccccactacaagctcaacgaagccaccaagcactttgctgccgcttaccctcacctcgtgagacgtaacgacgagcccatcattactgccttcttcaagaccgctcacctctttgtcaactacggagctgtgcccgagactgctcagattttcaccctcaaagagtctgccgctgcagccaaggccaagagcgactaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 26 - DNA, 7879 bp, Artificial Sequence
  sequence of pDMW237
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctctggccaacgacgctggcgagcgaatctgggctgccgtcaccgatcccgaaatcctcattggcaccttctcctacctgctcctgaagcctctcctgcgaaactctggtctcgtggacgagaagaaaggagcctaccgaacctccatgatctggtacaacgtcctcctggctctcttctctgccctgtccttctacgtgactgccaccgctctcggctgggactacggtactggagcctggctgcgaagacagaccggtgatactccccagcctctctttcagtgtccctctcctgtctgggactccaagctgttcacctggactgccaaggccttctactattctaagtacgtggagtacctcgacaccgcttggctggtcctcaagggcaagcgagtgtcctttctgcaggccttccatcactttggagctccctgggacgtctacctcggcattcgactgcacaacgagggtgtgtggatcttcatgttctttaactcgttcattcacaccatcatgtacacctactatggactgactgccgctggctacaagttcaaggccaagcctctgatcactgccatgcagatttgccagttcgtcggtggctttctcctggtctgggactacatcaacgttccctgcttcaactctgacaagggcaagctgttctcctgggctttcaactacgcctacgtcggatctgtctttctcctgttctgtcacttcttttaccaggacaacctggccaccaagaaatccgctaaggctggtaagcagctttagc

SEQ ID NO: 27 - protein, 263 aa, Isochrysis galbana
MALANDAGERIWAAVTDPEILIGTFSYLLLKPLLRNSGLVDEKKGAYRTSMIWYNVLLALFSALSFYVTATALGWDYGTGAWLRRQTGDTPQPLFQCPSPVWDSKLFTWTAKAFYYSKYVEYLDTAWLVLKGKRVSFLQAFHHFGAPWDVYLGIRLHNEGVWIFMFFNSFIHTIMYTYYGLTAAGYKFKAKPLITAMQICQFVGGFLLVWDYINVPCFNSDKGKLFSWAFNYAYVGSVFLLFCHFFYQDNLATKKSAKAGKQL

SEQ ID NO: 28 - DNA, 18 bp, Artificial Sequence
  sequence of the M13F universal primer
tgtaaaacgacggccagt

SEQ ID NO: 29 - DNA, 792 bp, Isochrysis galbana
atggccctcgcaaacgacgcgggagagcgcatctgggcggctgtgaccgacccggaaatcctcattggcaccttctcgtacttgctactcaaaccgctgctccgcaattccgggctggtggatgagaagaagggcgcatacaggacgtccatgatctggtacaacgttctgctggcgctcttctctgcgctgagcttctacgtgacggcgaccgccctcggctgggactatggtacgggcgcgtggctgcgcaggcaaaccggcgacacaccgcagccgctcttccagtgcccgtccccggtttgggactcgaagctcttcacatggaccgccaaggcattctattactccaagtacgtggagtacctcgacacggcctggctggtgctcaagggcaagagggtctcctttctccaggccttccaccactttggcgcgccgtgggatgtgtacctcggcattcggctgcacaacgagggcgtatggatcttcatgtttttcaactcgttcattcacaccatcatgtacacctactacggcctcaccgccgccgggtataagttcaaggccaagccgctcatcaccgcgatgcagatctgccagttcgtgggcggcttcctgttggtctgggactacatcaacgtcccctgcttcaactcggacaaagggaagttgttcagctgggctttcaactatgcatacgtcggctcggtcttcttgctcttctgccactttttctaccaggacaacttggcaacgaagaaatcggccaaggcgggcaagcagctctag

SEQ ID NO: 30 - DNA, 7783 bp, Artificial Sequence
  sequence of pY115
catggctctggccaacgacgctggcgagcgaatctgggctgccgtcaccgatcccgaaatcctcattggcaccttctcctacctgctcctgaagcctctcctgcgaaactctggtctcgtggacgagaagaaaggagcctaccgaacctccatgatctggtacaacgtcctcctggctctcttctctgccctgtccttctacgtgactgccaccgctctcggctgggactacggtactggagcctggctgcgaagacagaccggtgatactccccagcctctctttcagtgtccctctcctgtctgggactccaagctgttcacctggactgccaaggccttctactattctaagtacgtggagtacctcgacaccgcttggctggtcctcaagggcaagcgagtgtcctttctgcaggccttccatcactttggagctccctgggacgtctacctcggcattcgactgcacaacgagggtgtgtggatcttcatgttctttaactcgttcattcacaccatcatgtacacctactatggactgactgccgctggctacaagttcaaggccaagcctctgatcactgccatgcagatttgccagttcgtcggtggctttctcctggtctgggactacatcaacgttccctgcttcaactctgacaagggcaagctgttctcctgggctttcaactacgcctacgtcggatctgtctttctcctgttctgtcacttcttttaccaggacaacctggccaccaagaaatccgctaaggctggtaagcagctttagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtac

SEQ ID NO: 31 - DNA, 8704 bp, Artificial Sequence
  sequence of pBY1
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgatcacaagtttgtacaaaaaagctgaacgagaaacgtaaaatgatataaatatcaatatattaaattagattttgcataaaaaacagactacataatactgtaaaacacaacatatccagtcatattggcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagcattatgtagtctgttttttatgcaaaatctaatttaatatattgatatttatatcattttacgtttctcgttcagctttcttgtacaaagtggtgat

SEQ ID NO: 32 - DNA, 8145 bp, Artificial Sequence
  sequence of pBY2
  misc_feature (8028)..(8031): n is a, c, g, or t
  misc_feature (8063)..(8065): n is a, c, g, or t
  misc_feature (8067)..(8069): n is a, c, g, or t
  misc_feature (8071)..(8073): n is a, c, g, or t
  misc_feature (8075)..(8075): n is a, c, g, or t
  misc_feature (8126)..(8135): n is a, c, g, or t
cttgtacaaagtggtgatggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgatcacaagtttgtacaaaaaagttggattttttttcgaacacttaatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgatatttcctcctctgcggtggcctcttttgacctccccttgacacctataatgtggaggtgtcgggctctctccgtctcaccagcacttgactctgcaggtgctcacttttattttttacccatctttgcttgttgaccattcacctctcccacttccacatagtccattctaactgttgcagactgcggtccatnnnntccagagctcccaatgaccatacgcgacaccnnntnnnannncngcccattgtgcacaattcatagtggcatcgttttgccttgatacgtgtgcnnnnnnnnnnacccaacttt

SEQ ID NO: 33 - DNA, 7877 bp, Artificial Sequence
  sequence of pBY-FAE
cttgtacaaagtggtgatggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgatcacaagtttgtacaaaaaagcaggctccgcggccgcccccttcaccatggctctggccaacgacgctggcgagcgaatctgggctgccgtcaccgatcccgaaatcctcattggcaccttctcctacctgctcctgaagcctctcctgcgaaactctggtctcgtggacgagaagaaaggagcctaccgaacctccatgatctggtacaacgtcctcctggctctcttctctgccctgtccttctacgtgactgccaccgctctcggctgggactacggtactggagcctggctgcgaagacagaccggtgatactccccagcctctctttcagtgtccctctcctgtctgggactccaagctgttcacctggactgccaaggccttctactattctaagtacgtggagtacctcgacaccgcttggctggtcctcaagggcaagcgagtgtcctttctgcaggccttccatcactttggagctccctgggacgtctacctcggcattcgactgcacaacgagggtgtgtggatcttcatgttctttaactcgttcattcacaccatcatgtacacctactatggactgactgccgctggctacaagttcaaggccaagcctctgatcactgccatgcagatttgccagttcgtcggtggctttctcctggtctgggactacatcaacgttccctgcttcaactctgacaagggcaagctgttctcctgggctttcaactacgcctacgtcggatctgtctttctcctgttctgtcacttcttttaccaggacaacctggccaccaagaaatccgctaaggctggtaagcagctttagaagggtgggcgcgccgacccagcttt

SEQ ID NO: 34 - DNA, 7769 bp, Artificial Sequence
  the sequence of pY120
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagc

SEQ ID NO: 35 - DNA, 8306 bp, Artificial Sequence
  the sequence of pY119
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagc

SEQ ID NO: 36 - DNA, 7085 bp, Artificial Sequence
  the sequence of pKR72
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggatctggccggccggatctc

SEQ ID NO: 37 - DNA, 7873 bp, Artificial Sequence
  the sequence of pKR912
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagc

SEQ ID NO: 38 - DNA, 2540 bp, Artificial Sequence
  the sequence of pKS102
cgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatccgtcgacggcgcgcc

SEQ ID NO: 39 - DNA, 4359 bp, Artificial Sequence
  the sequence of pKR197
cgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggatctggccggccggatctcgtacggatccgtcgacgg

SEQ ID NO: 40 - DNA, 5147 bp, Artificial Sequence
  the sequence of pKR911
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagc

SEQ ID NO: 41 - DNA, 4826 bp, Artificial Sequence
  the sequence of pKS121
  misc_feature (3711)..(3711): n is a, c, g, or t
tcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccg

SEQ ID NO: 42 - DNA, 5252 bp, Artificial Sequence
  the sequence of pKR457
  misc_feature (3872)..(3872): n is a, c, g, or t
gtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgc

SEQ ID NO: 43 - DNA, 6559 bp, Artificial Sequence
  the sequence of pKR680
  misc_feature (4340)..(4340): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcgggaattcgattgaaatgaagtcaaagcgccaagcgcttccccttacaattgatggaacaacatatgatgtgtctgcctgggtcaatttccaccctggtggtgcggaaattatagagaattaccaaggaagggatgccactgatgccttcatggttatgcactctcaagaagccttcgacaagctcaagcgcatgcccaaaatcaatcccagttctgagttgccaccccaggctgcagtgaatgaagctcaagaggatttccggaagctccgagaagagttgatcgcaactggcatgtttgatgcctcccccctctggtactcatacaaaatcagcaccacactgggccttggagtgctgggttatttcctgatggttcagtatcagatgtatttcattggggcagtgttgcttgggatgcactatcaacagatgggctggctttctcatgacatttgccaccaccagactttcaagaaccggaactggaacaacctcgtgggactggtatttggcaatggtctgcaaggtttttccgtgacatggtggaaggacagacacaatgcacatcattcggcaaccaatgttcaagggcacgaccctgatattgacaacctccccctcttagcctggtctgaggatgacgtcacacgggcgtcaccgatttcccgcaagctcattcagttccagcagtactatttcttggtcatctgtatcttgttgcggttcatttggtgtttccagagcgtgttgaccgtgcgcagtttgaaggacagagataaccaattctatcgctctcagtataagaaggaggccattggcctcgccctgcactggaccttgaagaccctgttccacttattctttatgcccagcatcctcacatcgctgttggtgtttttcgtttcggagctggttggcggcttcggcattgcgatcgtggtgttcatgaaccactacccactggagaagatcggggactcagtctgggatggccatggattctcggttggccagatccatgagaccatgaacattcggcgagggattatcacagattggtttttcggaggcttgaattaccagattgagcaccatttgtggccgaccctccctcgccacaacctgacagcggttagctaccaggtggaacagctgtgccagaagcacaacctgccgtatcggaacccgctgccccatgaagggttggtcatcctgctgcgctatctggcggtgttcgcccggatggcggagaagcaacccgcggggaaggctctataaggaatcactagtgaattcgc

SEQ ID NO: 44 - DNA, 9014 bp, Artificial Sequence
  the sequence of pKR913
  misc_feature (7839)..(7839): n is a, c, g, or t
gtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcgaattcactagtgattccttatagagccttccccgcgggttgcttctccgccatccgggcgaacaccgccagatagcgcagcaggatgaccaacccttcatggggcagcgggttccgatacggcaggttgtgcttctggcacagctgttccacctggtagctaaccgctgtcaggttgtggcgagggagggtcggccacaaatggtgctcaatctggtaattcaagcctccgaaaaaccaatctgtgataatccctcgccgaatgttcatggtctcatggatctggccaaccgagaatccatggccatcccagactgagtccccgatcttctccagtgggtagtggttcatgaacaccacgatcgcaatgccgaagccgccaaccagctccgaaacgaaaaacaccaacagcgatgtgaggatgctgggcataaagaataagtggaacagggtcttcaaggtccagtgcagggcgaggccaatggcctccttcttatactgagagcgatagaattggttatctctgtccttcaaactgcgcacggtcaacacgctctggaaacaccaaatgaaccgcaacaagatacagatgaccaagaaatagtactgctggaactgaatgagcttgcgggaaatcggtgacgcccgtgtgacgtcatcctcagaccaggctaagagggggaggttgtcaatatcagggtcgtgcccttgaacattggttgccgaatgatgtgcattgtgtctgtccttccaccatgtcacggaaaaaccttgcagaccattgccaaataccagtcccacgaggttgttccagttccggttcttgaaagtctggtggtggcaaatgtcatgagaaagccagcccatctgttgatagtgcatcccaagcaacactgccccaatgaaatacatctgatactgaaccatcaggaaataacccagcactccaaggcccagtgtggtgctgattttgtatgagtaccagaggggggaggcatcaaacatgccagttgcgatcaactcttctcggagcttccggaaatcctcttgagcttcattcactgcagcctggggtggcaactcagaactgggattgattttgggcatgcgcttgagcttgtcgaaggcttcttgagagtgcataaccatgaaggcatcagtggcatcccttccttggtaattctctataatttccgcaccaccagggtggaaattgacccaggcagacacatcatatgttgttccatcaattgtaaggggaagcgcttggcgctttgacttcatttcaatcgaattcccgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 45 - DNA, 5561 bp, Artificial Sequence
  the sequence of pKR767
catggtcaatcaatgagacgccaacttcttaatctattgagacctgcaggtctagaagggcggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccc

SEQ ID NO: 46 - DNA, 8671 bp, Artificial Sequence
  the sequence of pKR328
ggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcagcccgggggatccgcccacgtacggtaccatctgctaatattttaaatcacatgcaagagaggaggcatggttccattttctaccttcacattatttgagaaaaacgaacttgttctgtgttttatttttgcccttcacattagtacaacgtggaagactcatggttacacagaatcatacataagtacaatgcttgtccctaagaaaacaagcactcgttgtattgaacctttacggctcatgcggccgcgaattcactagtgattgaattcgcggccgcttagtccgacttggccttggcggccgcggccgactctttgagcgtgaagatctgcgccgtctcgggcacagcgccgtagttgacaaagaggtgcgcggtcttgaagaaggccgtgatgatgggctcgtcgttcctgcgcacgaggtgcgggtacgcggccgcaaagtgcttggtggcttcgttgagcttgtagtgcggaatgatcgggaacaagtggtggacctggtgcgtgccaatgtggtggctcaggttgtccacgaacgcgccgtacgagcggtcgacgctcgagaggttgcccttgacgtacgtccactccgagtcgccgtaccacggcgtcgcttcgtcgttgtggtgcaagaaggtcgtaatgacgaggaacgaagcaaagacaaagagcggcgcatagtagtagaggcccatgacggcaaagccgagcgagtatgtgaggtacgcgtacgcggcgaagaaggcggcccagacgccgagcgacacgatgacggccgacgcgcggcgaaggaggagcgggtcccacgggtcaaagtggctcatcgtgcgcggggcatacccgaccttcaagtagacaaaccacgcaccgccgagcgtgtagacccattggcgcacgtcctggaggtccttgaccgaccggtgcgggtaaaagatctcgtccttatcaatgttgcccgtgttcttgtggtggtggcggtgcgtcacgcgccagctctcgaacggcgtcaaaatcgcagagtgcatgatgcagccgatgataaagttgacgctgtggtagcgcgagaaggccgagtggccgcagtcgtggccgaccgtgaagaagccccagaagatgacgccctgcacgtagatgtaggtggcgcaaacgagcgcgtggagcagaacgttatcggcaatgaacggcgtcgagcgcgccgcgtagagcagcgccgccgaggccgacgcgttgaagatcgcgcgggccgtgtagtagagcgagaggccgaggttcgactcaaagcacgcgttcgggatcgagtgcttgagctccgtgagcgtcgggaactcgaccttcgtcttatcctcagtcatgcggccgctgaagtattgcttcttagttaacctttcctttctctctcagctatgtgaattcattttgctttcgtcacaatttatatagtgaaattggatctttggagttaacgccttcacaggattatcgtgttagaacaatgctttttcatgttctaattagtagtacattacaaatgtgcactctattcaataagcatcttttggcacgttaataaatcatgtgaaaaaaaaatactactatttcaaagaaagtgttgtaaaaagaaacggaaagagagctggcttcagttgttgagacttgtttgctagtaaaaatggtgtgaagagtgattcatggtgaggtggtttttcgtccctttctgtttgcatgaaaaacaaatggcaagagatgacgtaggattccttcccttaacgattatctgtttttaatttcaaatatacatataggaatttatgaattactaaggttgtaaaatatgctggtcatttatttatggctaaaatatttttttttctcgtaaatataaaaatatttaaaatttatttttatcatattttttatccttataaaattatgtgtacaacctatataaaaaaatatcatatttaatattgattatatgtttaatcaatataaaaaatcattatcatatatttagatttattcgaatatacatctaaacaaaaaataacatattttaattttatgaagaaaaaaaaatattttatcctttatttatttaagattaattaatagttatgtattgtggaaagacttttacacatgcaatagatatactgaatcaattagatgccaatgctgagttggaaatcacttgaggaggggaggagacttgccaatgcttttcagtttcatttaaatgatttagtggaggagatagagtagtgataaaggcatgccccaattttggagtgtatatatgagtggaaataagagagggatagagagaaaaaataaagagagtaaaaataattaatgtgaaatgatatgataaaaaaataaagaaagagataaagagaaaaatgaaatgagagatagatgaaatagagagtagatacatgtttgtttaggttttttttaggaaataacacatttttttctcatcacttattactcactgtcaatttcctctctttcaatcataatgatatgatttgtttaacaaaaatgtgaaaaaacatataaagtaaaatatttttataaattgataaataaaaatttacaaaatttatttcttattaaattgaatagaaaatgaaagaaaagaaaagaaaaagtatatataaaatgatatagctttaaaaagaataaatttttcatatcagtctttttttaataatttagaaatatttaagtatatagcaaaaatataatgtactttacatatgcataaataataatttgaaaatagaactaatagaatagagaaaaaagtaatataataattaactatatgaaaatttagaagggacaatatttttaattaagaatataaacaatatttcttttcatgtaatgagggacggatgtacggggccagtgttggagtcaaagccaaaatagtcacggggaaattaatgcactgcatgactattcgaaaaaattcactagccttacttagatgttagattaatagctagggggtgcagataattttgaaaggcatgaaaaacattaatttgtacattgcaagcttttgatgacaagctttgcaattgttcacactaccttatgccatttataaatagagtgattggcatatgaaggaaatcatgagagtcgaagcgaaaaacaaagcttgagagtgtaggaaaaatacagtttttttggtaaaaatacagtatttgaataggagcgaaaaatatcctttcaaaatgatccttttctttttttttttttttcttgttgttcttggtcagttattcaaaggaaaagggattgaaataaaaacttgcatgtgggatcgtacgtcgagtcgacctgca

SEQ ID NO: 47 - DNA, 9892 bp, Artificial Sequence
  the sequence of pKR886
ggtcgactcgacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcatgactgaggataagacgaaggtcgagttcccgacgctcacggagctcaagcactcgatcccgaacgcgtgctttgagtcgaacctcggcctctcgctctactacacggcccgcgcgatcttcaacgcgtcggcctcggcggcgctgctctacgcggcgcgctcgacgccgttcattgccgataacgttctgctccacgcgctcgtttgcgccacctacatctacgtgcagggcgtcatcttctggggcttcttcacggtcggccacgactgcggccactcggccttctcgcgctaccacagcgtcaactttatcatcggctgcatcatgcactctgcgattttgacgccgttcgagagctggcgcgtgacgcaccgccaccaccacaagaacacgggcaacattgataaggacgagatcttttacccgcaccggtcggtcaaggacctccaggacgtgcgccaatgggtctacacgctcggcggtgcgtggtttgtctacttgaaggtcgggtatgccccgcgcacgatgagccactttgacccgtgggacccgctcctccttcgccgcgcgtcggccgtcatcgtgtcgctcggcgtctgggccgccttcttcgccgcgtacgcgtacctcacatactcgctcggctttgccgtcatgggcctctactactatgcgccgctctttgtctttgcttcgttcctcgtcattacgaccttcttgcaccacaacgacgaagcgacgccgtggtacggcgactcggagtggacgtacgtcaagggcaacctctcgagcgtcgaccgctcgtacggcgcgttcgtggacaacctgagccaccacattggcacgcaccaggtccaccacttgttcccgatcattccgcactacaagctcaacgaagccaccaagcactttgcggccgcgtacccgcacctcgtgcgcaggaacgacgagcccatcatcacggccttcttcaagaccgcgcacctctttgtcaactacggcgctgtgcccgagacggcgcagatcttcacgctcaaagagtcggccgcggccgccaaggccaagtcggactaagcggccgcgaattcaatcactagtgaattcgcggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtaccgtacgtgggcggatcccccgggctgca

SEQ ID NO: 48 - DNA, 9892 bp, Artificial Sequence
  the sequence of pKR886r
ggtcgactcgacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcagcccgggggatccgcccacgtacggtaccatctgctaatattttaaatcacatgcaagagaggaggcatggttccattttctaccttcacattatttgagaaaaacgaacttgttctgtgttttatttttgcccttcacattagtacaacgtggaagactcatggttacacagaatcatacataagtacaatgcttgtccctaagaaaacaagcactcgttgtattgaacctttacggctcatgcggccgcgaattcactagtgattgaattcgcggccgcttagtccgacttggccttggcggccgcggccgactctttgagcgtgaagatctgcgccgtctcgggcacagcgccgtagttgacaaagaggtgcgcggtcttgaagaaggccgtgatgatgggctcgtcgttcctgcgcacgaggtgcgggtacgcggccgcaaagtgcttggtggcttcgttgagcttgtagtgcggaatgatcgggaacaagtggtggacctggtgcgtgccaatgtggtggctcaggttgtccacgaacgcgccgtacgagcggtcgacgctcgagaggttgcccttgacgtacgtccactccgagtcgccgtaccacggcgtcgcttcgtcgttgtggtgcaagaaggtcgtaatgacgaggaacgaagcaaagacaaagagcggcgcatagtagtagaggcccatgacggcaaagccgagcgagtatgtgaggtacgcgtacgcggcgaagaaggcggcccagacgccgagcgacacgatgacggccgacgcgcggcgaaggaggagcgggtcccacgggtcaaagtggctcatcgtgcgcggggcatacccgaccttcaagtagacaaaccacgcaccgccgagcgtgtagacccattggcgcacgtcctggaggtccttgaccgaccggtgcgggtaaaagatctcgtccttatcaatgttgcccgtgttcttgtggtggtggcggtgcgtcacgcgccagctctcgaacggcgtcaaaatcgcagagtgcatgatgcagccgatgataaagttgacgctgtggtagcgcgagaaggccgagtggccgcagtcgtggccgaccgtgaagaagccccagaagatgacgccctgcacgtagatgtaggtggcgcaaacgagcgcgtggagcagaacgttatcggcaatgaacggcgtcgagcgcgccgcgtagagcagcgccgccgaggccgacgcgttgaagatcgcgcgggccgtgtagtagagcgagaggccgaggttcgactcaaagcacgcgttcgggatcgagtgcttgagctccgtgagcgtcgggaactcgaccttcgtcttatcctcagtcatgcggccgctgaagtattgcttcttagttaacctttcctttctctctcagctatgtgaattcattttgctttcgtcacaatttatatagtgaaattggatctttggagttaacgccttcacaggattatcgtgttagaacaatgctttttcatgttctaattagtagtacattacaaatgtgcactctattcaataagcatcttttggcacgttaataaatcatgtgaaaaaaaaatactactatttcaaagaaagtgttgtaaaaagaaacggaaagagagctggcttcagttgttgagacttgtttgctagtaaaaatggtgtgaagagtgattcatggtgaggtggtttttcgtccctttctgtttgcatgaaaaacaaatggcaagagatgacgtaggattccttcccttaacgattatctgtttttaatttcaaatatacatataggaatttatgaattactaaggttgtaaaatatgctggtcatttatttatggctaaaatatttttttttctcgtaaatataaaaatatttaaaatttatttttatcatattttttatccttataaaattatgtgtacaacctatataaaaaaatatcatatttaatattgattatatgtttaatcaatataaaaaatcattatcatatatttagatttattcgaatatacatctaaacaaaaaataacatattttaattttatgaagaaaaaaaaatattttatcctttatttatttaagattaattaatagttatgtattgtggaaagacttttacacatgcaatagatatactgaatcaattagatgccaatgctgagttggaaatcacttgaggaggggaggagacttgccaatgcttttcagtttcatttaaatgatttagtggaggagatagagtagtgataaaggcatgccccaattttggagtgtatatatgagtggaaataagagagggatagagagaaaaaataaagagagtaaaaataattaatgtgaaatgatatgataaaaaaataaagaaagagataaagagaaaaatgaaatgagagatagatgaaatagagagtagatacatgtttgtttaggttttttttaggaaataacacatttttttctcatcacttattactcactgtcaatttcctctctttcaatcataatgatatgatttgtttaacaaaaatgtgaaaaaacatataaagtaaaatatttttataaattgataaataaaaatttacaaaatttatttcttattaaattgaatagaaaatgaaagaaaagaaaagaaaaagtatatataaaatgatatagctttaaaaagaataaatttttcatatcagtctttttttaataatttagaaatatttaagtatatagcaaaaatataatgtactttacatatgcataaataataatttgaaaatagaactaatagaatagagaaaaaagtaatataataattaactatatgaaaatttagaagggacaatatttttaattaagaatataaacaatatttcttttcatgtaatgagggacggatgtacggggccagtgttggagtcaaagccaaaatagtcacggggaaattaatgcactgcatgactattcgaaaaaattcactagccttacttagatgttagattaatagctagggggtgcagataattttgaaaggcatgaaaaacattaatttgtacattgcaagcttttgatgacaagctttgcaattgttcacactaccttatgccatttataaatagagtgattggcatatgaaggaaatcatgagagtcgaagcgaaaaacaaagcttgagagtgtaggaaaaatacagtttttttggtaaaaatacagtatttgaataggagcgaaaaatatcctttcaaaatgatccttttctttttttttttttttcttgttgttcttggtcagttattcaaaggaaaagggattgaaataaaaacttgcatgtgggatcgtacgtcgagtcgacctgca

SEQ ID NO: 49 - DNA, 6021 bp, Artificial Sequence
  the sequence of pKR271
ggccgcgaattcaatcactagtgaattcgcggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtaccgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcatgactgaggataagacgaaggtcgagttcccgacgctcacggagctcaagcactcgatcccgaacgcgtgctttgagtcgaacctcggcctctcgctctactacacggcccgcgcgatcttcaacgcgtcggcctcggcggcgctgctctacgcggcgcgctcgacgccgttcattgccgataacgttctgctccacgcgctcgtttgcgccacctacatctacgtgcagggcgtcatcttctggggcttcttcacggtcggccacgactgcggccactcggccttctcgcgctaccacagcgtcaactttatcatcggctgcatcatgcactctgcgattttgacgccgttcgagagctggcgcgtgacgcaccgccaccaccacaagaacacgggcaacattgataaggacgagatcttttacccgcaccggtcggtcaaggacctccaggacgtgcgccaatgggtctacacgctcggcggtgcgtggtttgtctacttgaaggtcgggtatgccccgcgcacgatgagccactttgacccgtgggacccgctcctccttcgccgcgcgtcggccgtcatcgtgtcgctcggcgtctgggccgccttcttcgccgcgtacgcgtacctcacatactcgctcggctttgccgtcatgggcctctactactatgcgccgctctttgtctttgcttcgttcctcgtcattacgaccttcttgcaccacaacgacgaagcgacgccgtggtacggcgactcggagtggacgtacgtcaagggcaacctctcgagcgtcgaccgctcgtacggcgcgttcgtggacaacctgagccaccacattggcacgcaccaggtccaccacttgttcccgatcattccgcactacaagctcaacgaagccaccaagcactttgcggccgcgtacccgcacctcgtgcgcaggaacgacgagcccatcatcacggccttcttcaagaccgcgcacctctttgtcaactacggcgctgtgcccgagacggcgcagatcttcacgctcaaagagtcggccgcggccgccaaggccaagtcggactaagc

SEQ ID NO: 50 - DNA, 6524 bp, Artificial Sequence
  the sequence of pKR226
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggtcgactcgac

SEQ ID NO: 51 - DNA, 13514 bp, Artificial Sequence
  the sequence of pKR275
  misc_feature (1192)..(1192): n is a, c, g, or t
  misc_feature (2675)..(2675): n is a, c, g, or t
ggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcctctctctctctctcttctctctttctctccccctctctccggcgatggttgttgctatggaccaacgcaccaatgtgaacggagatcccggcgccggagaccggaagaaagaagaaaggtttgatccgagtgcacaaccaccgttcaagatcggagatataagggcggcgattcctaagcactgttgggttaagagtcctttgagatcaatgagttacgtcgtcagagacattatcgccgtcgcggctttggccatcgctgccgtgtatgttgatagctggttcctttggcctctttattgggccgcccaaggaacacttttctgggccatctttgttctcggccacgactgtggacatgggagtttctcagacattcctctactgaatagtgtggttggtcacattcttcattctttcatcctcgttccttaccatggttggagaataagccaccggacacaccaccagaaccatggccatgttgaaaacgacgagtcatgggttccgttaccagaaagggtgtacaagaaattgccccacagtactcggatgctcagatacnctgtccctctccccatgctcgcatatcctctctatttgtgctacagaagtcctggaaaagaaggatcacattttaacccatacagtagtttatttgctccaagcgagagaaagcttattgcaacttcaactacttgttggtccataatgttcgtcagtcttatcgctctatctttcgtcttcggtccactcgcggttcttaaagtctacggtgtaccgtacattatctttgtgatgtggttggatgctgtcacgtatttgcatcatcatggtcacgatgagaagttgccttggtatagaggcaaggaatggagttatctacgtggaggattaacaacaattgatagagattacggaatctttaacaacattcatcacgacattggaactcacgtgatccatcatctcttcccacaaatccctcactatcacttggtcgacgccacgaaagcagctaaacatgtgttgggaagatactacagagaaccaaagacgtcaggagcaataccgatccacttggtggagagtttggtcgcaagtattaagaaagatcattacgtcagcgacactggtgatattgtcttctacgagacagatccagatctctacgtttacgcttctgacaaatctaaaatcaattaatctccatttgtttagctctattaggaataaaccagcccacttttaaaatttttatttcttgttgtttttaagttaaaagtgtactcgtgaaactcttttttttttctttttttttattaatgtatttacattacaaggcgtaaagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcatgactgaggataagacgaaggtcgagttcccgacgctcacggagctcaagcactcgatcccgaacgcgtgctttgagtcgaacctcggcctctcgctctactacacggcccgcgcgatcttcaacgcgtcggcctcggcggcgctgctctacgcggcgcgctcgacgccgttcattgccgataacgttctgctccacgcgctcgtttgcgccacctacatctacgtgcagggcgtcatcttctggggcttcttcacggtcggccacgactgcggccactcggccttctcgcgctaccacagcgtcaactttatcatcggctgcatcatgcactctgcgattttgacgccgttcgagagctggcgcgtgacgcaccgccaccaccacaagaacacgggcaacattgataaggacgagatcttttacccgcaccggtcggtcaaggacctccaggacgtgcgccaatgggtctacacgctcggcggtgcgtggtttgtctacttgaaggtcgggtatgccccgcgcacgatgagccactttgacccgtgggacccgctcctccttcgccgcgcgtcggccgtcatcgtgtcgctcggcgtctgggccgccttcttcgccgcgtacgcgtacctcacatactcgctcggctttgccgtcatgggcctctactactatgcgccgctctttgtctttgcttcgttcctcgtcattacgaccttcttgcaccacaacgacgaagcgacgccgtggtacggcgactcggagtggacgtacgtcaagggcaacctctcgagcgtcgaccgctcgtacggcgcgttcgtggacaacctgagccaccacattggcacgcaccaggtccaccacttgttcccgatcattccgcactacaagctcaacgaagccaccaagcactttgcggccgcgtacccgcacctcgtgcgcaggaacgacgagcccatcatcacggccttcttcaagaccgcgcacctctttgtcaactacggcgctgtgcccgagacggcgcagatcttcacgctcaaagagtcggccgcggccgccaaggccaagtcggactaagcggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtaccgtacgtgggcggatcccccgggctgca

SEQ ID NO: 52 - DNA, 12323 bp, Artificial Sequence
  the sequence of pKR329
  misc_feature (1201)..(1201): n is a, c, g, or t
  misc_feature (2684)..(2684): n is a, c, g, or t
ggatctggccggccggatctcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcctctctctctctctcttctctctttctctccccctctctccggcgatggttgttgctatggaccaacgcaccaatgtgaacggagatcccggcgccggagaccggaagaaagaagaaaggtttgatccgagtgcacaaccaccgttcaagatcggagatataagggcggcgattcctaagcactgttgggttaagagtcctttgagatcaatgagttacgtcgtcagagacattatcgccgtcgcggctttggccatcgctgccgtgtatgttgatagctggttcctttggcctctttattgggccgcccaaggaacacttttctgggccatctttgttctcggccacgactgtggacatgggagtttctcagacattcctctactgaatagtgtggttggtcacattcttcattctttcatcctcgttccttaccatggttggagaataagccaccggacacaccaccagaaccatggccatgttgaaaacgacgagtcatgggttccgttaccagaaagggtgtacaagaaattgccccacagtactcggatgctcagatacnctgtccctctccccatgctcgcatatcctctctatttgtgctacagaagtcctggaaaagaaggatcacattttaacccatacagtagtttatttgctccaagcgagagaaagcttattgcaacttcaactacttgttggtccataatgttcgtcagtcttatcgctctatctttcgtcttcggtccactcgcggttcttaaagtctacggtgtaccgtacattatctttgtgatgtggttggatgctgtcacgtatttgcatcatcatggtcacgatgagaagttgccttggtatagaggcaaggaatggagttatctacgtggaggattaacaacaattgatagagattacggaatctttaacaacattcatcacgacattggaactcacgtgatccatcatctcttcccacaaatccctcactatcacttggtcgacgccacgaaagcagctaaacatgtgttgggaagatactacagagaaccaaagacgtcaggagcaataccgatccacttggtggagagtttggtcgcaagtattaagaaagatcattacgtcagcgacactggtgatattgtcttctacgagacagatccagatctctacgtttacgcttctgacaaatctaaaatcaattaatctccatttgtttagctctattaggaataaaccagcccacttttaaaatttttatttcttgttgtttttaagttaaaagtgtactcgtgaaactcttttttttttctttttttttattaatgtatttacattacaaggcgtaaagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcagcccgggggatccgcccacgtacggtaccatctgctaatattttaaatcacatgcaagagaggaggcatggttccattttctaccttcacattatttgagaaaaacgaacttgttctgtgttttatttttgcccttcacattagtacaacgtggaagactcatggttacacagaatcatacataagtacaatgcttgtccctaagaaaacaagcactcgttgtattgaacctttacggctcatgcggccgcgaattcactagtgattgaattcgcggccgcttagtccgacttggccttggcggccgcggccgactctttgagcgtgaagatctgcgccgtctcgggcacagcgccgtagttgacaaagaggtgcgcggtcttgaagaaggccgtgatgatgggctcgtcgttcctgcgcacgaggtgcgggtacgcggccgcaaagtgcttggtggcttcgttgagcttgtagtgcggaatgatcgggaacaagtggtggacctggtgcgtgccaatgtggtggctcaggttgtccacgaacgcgccgtacgagcggtcgacgctcgagaggttgcccttgacgtacgtccactccgagtcgccgtaccacggcgtcgcttcgtcgttgtggtgcaagaaggtcgtaatgacgaggaacgaagcaaagacaaagagcggcgcatagtagtagaggcccatgacggcaaagccgagcgagtatgtgaggtacgcgtacgcggcgaagaaggcggcccagacgccgagcgacacgatgacggccgacgcgcggcgaaggaggagcgggtcccacgggtcaaagtggctcatcgtgcgcggggcatacccgaccttcaagtagacaaaccacgcaccgccgagcgtgtagacccattggcgcacgtcctggaggtccttgaccgaccggtgcgggtaaaagatctcgtccttatcaatgttgcccgtgttcttgtggtggtggcggtgcgtcacgcgccagctctcgaacggcgtcaaaatcgcagagtgcatgatgcagccgatgataaagttgacgctgtggtagcgcgagaaggccgagtggccgcagtcgtggccgaccgtgaagaagccccagaagatgacgccctgcacgtagatgtaggtggcgcaaacgagcgcgtggagcagaacgttatcggcaatgaacggcgtcgagcgcgccgcgtagagcagcgccgccgaggccgacgcgttgaagatcgcgcgggccgtgtagtagagcgagaggccgaggttcgactcaaagcacgcgttcgggatcgagtgcttgagctccgtgagcgtcgggaactcgaccttcgtcttatcctcagtcatgcggccgctgaagtattgcttcttagttaacctttcctttctctctcagctatgtgaattcattttgctttcgtcacaatttatatagtgaaattggatctttggagttaacgccttcacaggattatcgtgttagaacaatgctttttcatgttctaattagtagtacattacaaatgtgcactctattcaataagcatcttttggcacgttaataaatcatgtgaaaaaaaaatactactatttcaaagaaagtgttgtaaaaagaaacggaaagagagctggcttcagttgttgagacttgtttgctagtaaaaatggtgtgaagagtgattcatggtgaggtggtttttcgtccctttctgtttgcatgaaaaacaaatggcaagagatgacgtaggattccttcccttaacgattatctgtttttaatttcaaatatacatataggaatttatgaattactaaggttgtaaaatatgctggtcatttatttatggctaaaatatttttttttctcgtaaatataaaaatatttaaaatttatttttatcatattttttatccttataaaattatgtgtacaacctatataaaaaaatatcatatttaatattgattatatgtttaatcaatataaaaaatcattatcatatatttagatttattcgaatatacatctaaacaaaaaataacatattttaattttatgaagaaaaaaaaatattttatcctttatttatttaagattaattaatagttatgtattgtggaaagacttttacacatgcaatagatatactgaatcaattagatgccaatgctgagttggaaatcacttgaggaggggaggagacttgccaatgcttttcagtttcatttaaatgatttagtggaggagatagagtagtgataaaggcatgccccaattttggagtgtatatatgagtggaaataagagagggatagagagaaaaaataaagagagtaaaaataattaatgtgaaatgatatgataaaaaaataaagaaagagataaagagaaaaatgaaatgagagatagatgaaatagagagtagatacatgtttgtttaggttttttttaggaaataacacatttttttctcatcacttattactcactgtcaatttcctctctttcaatcataatgatatgatttgtttaacaaaaatgtgaaaaaacatataaagtaaaatatttttataaattgataaataaaaatttacaaaatttatttcttattaaattgaatagaaaatgaaagaaaagaaaagaaaaagtatatataaaatgatatagctttaaaaagaataaatttttcatatcagtctttttttaataatttagaaatatttaagtatatagcaaaaatataatgtactttacatatgcataaataataatttgaaaatagaactaatagaatagagaaaaaagtaatataataattaactatatgaaaatttagaagggacaatatttttaattaagaatataaacaatatttcttttcatgtaatgagggacggatgtacggggccagtgttggagtcaaagccaaaatagtcacggggaaattaatgcactgcatgactattcgaaaaaattcactagccttacttagatgttagattaatagctagggggtgcagataattttgaaaggcatgaaaaacattaatttgtacattgcaagcttttgatgacaagctttgcaattgttcacactaccttatgccatttataaatagagtgattggcatatgaaggaaatcatgagagtcgaagcgaaaaacaaagcttgagagtgtaggaaaaatacagtttttttggtaaaaatacagtatttgaataggagcgaaaaatatcctttcaaaatgatccttttctttttttttttttttcttgttgttcttggtcagttattcaaaggaaaagggattgaaataaaaacttgcatgtgggatcgtacgtcgagtcgacctgca

SEQ ID NO: 53 - DNA, 12456 bp, Artificial Sequence
  the sequence of pKR585
  misc_feature (1201)..(1201): n is a, c, g, or t
ggatctggccggccggatctcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcacaatggcgactcgacagcgaactgccaccactgttgtggtcgaggaccttcccaaggtcactcttgaggccaagtctgaacctgtgttccccgatatcaagaccatcaaggatgccattcccgcgcactgcttccagccctcgctcgtcacctcattctactacgtcttccgcgattttgccatggtctctgccctcgtctgggctgctctcacctacatccccagcatccccgaccagaccctccgcgtcgcagcttggatggtctacggcttcgtccagggtctgttctgcaccggtgtctggattctcggccatgagtgcggccacggtgctttctctctccacggaaaggtcaacaatgtgaccggctggttcctccactcgttcctcctcgtcccctacttcagctggaagtactctcaccaccgccaccaccgcttcaccggccacatggatctcgacatggctttcgtccccaagactgagcccaagccctccaagtcgctcatgattgctggcattgacgtcgccgagcttgttgaggacacccccgctgctcagatggtcaagctcatcttccaccagcttttcggatggcaggcgtacctcttcttcaacgctagctctggcaagggcagcaagcagtgggagcccaagactggcctctccaagtggttccgagtcagtcacttcgagcctaccagcgctgtcttccgccccaacgaggccatcttcatcctcatctccgatatcggtcttgctctaatgggaactgctctgtactttgcttccaagcaagttggtgtttcgaccattctcttcctctaccttgttccctacctgtgggttcaccactggctcgttgccattacctacctccaccaccaccacaccgagctccctcactacaccgctgagggctggacctacgtcaagggagctctcgccactgtcgaccgtgagtttggcttcatcggaaagcacctcttccacggtatcattgagaagcacgttgttcaccatctcttccctaagatccccttctacaaggctgacgaggccaccgaggccatcaagcccgtcattggcgaccactactgccacgacgaccgaagcttcctgggccagctgtggaccatcttcggcacgctcaagtacgtcgagcacgaccctgcccgacccggtgccatgcgatggaacaaggactaggctaggcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcagcccgggggatccgcccacgtacggtaccatctgctaatattttaaatcacatgcaagagaggaggcatggttccattttctaccttcacattatttgagaaaaacgaacttgttctgtgttttatttttgcccttcacattagtacaacgtggaagactcatggttacacagaatcatacataagtacaatgcttgtccctaagaaaacaagcactcgttgtattgaacctttacggctcatgcggccgcgaattcactagtgattgaattcgcggccgcttagtccgacttggccttggcggccgcggccgactctttgagcgtgaagatctgcgccgtctcgggcacagcgccgtagttgacaaagaggtgcgcggtcttgaagaaggccgtgatgatgggctcgtcgttcctgcgcacgaggtgcgggtacgcggccgcaaagtgcttggtggcttcgttgagcttgtagtgcggaatgatcgggaacaagtggtggacctggtgcgtgccaatgtggtggctcaggttgtccacgaacgcgccgtacgagcggtcgacgctcgagaggttgcccttgacgtacgtccactccgagtcgccgtaccacggcgtcgcttcgtcgttgtggtgcaagaaggtcgtaatgacgaggaacgaagcaaagacaaagagcggcgcatagtagtagaggcccatgacggcaaagccgagcgagtatgtgaggtacgcgtacgcggcgaagaaggcggcccagacgccgagcgacacgatgacggccgacgcgcggcgaaggaggagcgggtcccacgggtcaaagtggctcatcgtgcgcggggcatacccgaccttcaagtagacaaaccacgcaccgccgagcgtgtagacccattggcgcacgtcctggaggtccttgaccgaccggtgcgggtaaaagatctcgtccttatcaatgttgcccgtgttcttgtggtggtggcggtgcgtcacgcgccagctctcgaacggcgtcaaaatcgcagagtgcatgatgcagccgatgataaagttgacgctgtggtagcgcgagaaggccgagtggccgcagtcgtggccgaccgtgaagaagccccagaagatgacgccctgcacgtagatgtaggtggcgcaaacgagcgcgtggagcagaacgttatcggcaatgaacggcgtcgagcgcgccgcgtagagcagcgccgccgaggccgacgcgttgaagatcgcgcgggccgtgtagtagagcgagaggccgaggttcgactcaaagcacgcgttcgggatcgagtgcttgagctccgtgagcgtcgggaactcgaccttcgtcttatcctcagtcatgcggccgctgaagtattgcttcttagttaacctttcctttctctctcagctatgtgaattcattttgctttcgtcacaatttatatagtgaaattggatctttggagttaacgccttcacaggattatcgtgttagaacaatgctttttcatgttctaattagtagtacattacaaatgtgcactctattcaataagcatcttttggcacgttaataaatcatgtgaaaaaaaaatactactatttcaaagaaagtgttgtaaaaagaaacggaaagagagctggcttcagttgttgagacttgtttgctagtaaaaatggtgtgaagagtgattcatggtgaggtggtttttcgtccctttctgtttgcatgaaaaacaaatggcaagagatgacgtaggattccttcccttaacgattatctgtttttaatttcaaatatacatataggaatttatgaattactaaggttgtaaaatatgctggtcatttatttatggctaaaatatttttttttctcgtaaatataaaaatatttaaaatttatttttatcatattttttatccttataaaattatgtgtacaacctatataaaaaaatatcatatttaatattgattatatgtttaatcaatataaaaaatcattatcatatatttagatttattcgaatatacatctaaacaaaaaataacatattttaattttatgaagaaaaaaaaatattttatcctttatttatttaagattaattaatagttatgtattgtggaaagacttttacacatgcaatagatatactgaatcaattagatgccaatgctgagttggaaatcacttgaggaggggaggagacttgccaatgcttttcagtttcatttaaatgatttagtggaggagatagagtagtgataaaggcatgccccaattttggagtgtatatatgagtggaaataagagagggatagagagaaaaaataaagagagtaaaaataattaatgtgaaatgatatgataaaaaaataaagaaagagataaagagaaaaatgaaatgagagatagatgaaatagagagtagatacatgtttgtttaggttttttttaggaaataacacatttttttctcatcacttattactcactgtcaatttcctctctttcaatcataatgatatgatttgtttaacaaaaatgtgaaaaaacatataaagtaaaatatttttataaattgataaataaaaatttacaaaatttatttcttattaaattgaatagaaaatgaaagaaaagaaaagaaaaagtatatataaaatgatatagctttaaaaagaataaatttttcatatcagtctttttttaataatttagaaatatttaagtatatagcaaaaatataatgtactttacatatgcataaataataatttgaaaatagaactaatagaatagagaaaaaagtaatataataattaactatatgaaaatttagaagggacaatatttttaattaagaatataaacaatatttcttttcatgtaatgagggacggatgtacggggccagtgttggagtcaaagccaaaatagtcacggggaaattaatgcactgcatgactattcgaaaaaattcactagccttacttagatgttagattaatagctagggggtgcagataattttgaaaggcatgaaaaacattaatttgtacattgcaagcttttgatgacaagctttgcaattgttcacactaccttatgccatttataaatagagtgattggcatatgaaggaaatcatgagagtcgaagcgaaaaacaaagcttgagagtgtaggaaaaatacagtttttttggtaaaaatacagtatttgaataggagcgaaaaatatcctttcaaaatgatccttttctttttttttttttttcttgttgttcttggtcagttattcaaaggaaaagggattgaaataaaaacttgcatgtgggatcgtacgtcgagtcgacctgca

SEQ ID NO: 54 - DNA, 9088 bp, Artificial Sequence
  the sequence of pKR578
  misc_feature (6951)..(6951): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcacaatggcgactcgacagcgaactgccaccactgttgtggtcgaggaccttcccaaggtcactcttgaggccaagtctgaacctgtgttccccgatatcaagaccatcaaggatgccattcccgcgcactgcttccagccctcgctcgtcacctcattctactacgtcttccgcgattttgccatggtctctgccctcgtctgggctgctctcacctacatccccagcatccccgaccagaccctccgcgtcgcagcttggatggtctacggcttcgtccagggtctgttctgcaccggtgtctggattctcggccatgagtgcggccacggtgctttctctctccacggaaaggtcaacaatgtgaccggctggttcctccactcgttcctcctcgtcccctacttcagctggaagtactctcaccaccgccaccaccgcttcaccggccacatggatctcgacatggctttcgtccccaagactgagcccaagccctccaagtcgctcatgattgctggcattgacgtcgccgagcttgttgaggacacccccgctgctcagatggtcaagctcatcttccaccagcttttcggatggcaggcgtacctcttcttcaacgctagctctggcaagggcagcaagcagtgggagcccaagactggcctctccaagtggttccgagtcagtcacttcgagcctaccagcgctgtcttccgccccaacgaggccatcttcatcctcatctccgatatcggtcttgctctaatgggaactgctctgtactttgcttccaagcaagttggtgtttcgaccattctcttcctctaccttgttccctacctgtgggttcaccactggctcgttgccattacctacctccaccaccaccacaccgagctccctcactacaccgctgagggctggacctacgtcaagggagctctcgccactgtcgaccgtgagtttggcttcatcggaaagcacctcttccacggtatcattgagaagcacgttgttcaccatctcttccctaagatccccttctacaaggctgacgaggccaccgaggccatcaagcccgtcattggcgaccactactgccacgacgaccgaagcttcctgggccagctgtggaccatcttcggcacgctcaagtacgtcgagcacgaccctgcccgacccggtgccatgcgatggaacaaggactaggctaggc

SEQ ID NO: 55 - DNA, 10309 bp, Artificial Sequence
  the sequence of pKR667
  misc_feature (7704)..(7704): n is a, c, g, or t
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcacaatggcgactcgacagcgaactgccaccactgttgtggtcgaggaccttcccaaggtcactcttgaggccaagtctgaacctgtgttccccgatatcaagaccatcaaggatgccattcccgcgcactgcttccagccctcgctcgtcacctcattctactacgtcttccgcgattttgccatggtctctgccctcgtctgggctgctctcacctacatccccagcatccccgaccagaccctccgcgtcgcagcttggatggtctacggcttcgtccagggtctgttctgcaccggtgtctggattctcggccatgagtgcggccacggtgctttctctctccacggaaaggtcaacaatgtgaccggctggttcctccactcgttcctcctcgtcccctacttcagctggaagtactctcaccaccgccaccaccgcttcaccggccacatggatctcgacatggctttcgtccccaagactgagcccaagccctccaagtcgctcatgattgctggcattgacgtcgccgagcttgttgaggacacccccgctgctcagatggtcaagctcatcttccaccagcttttcggatggcaggcgtacctcttcttcaacgctagctctggcaagggcagcaagcagtgggagcccaagactggcctctccaagtggttccgagtcagtcacttcgagcctaccagcgctgtcttccgccccaacgaggccatcttcatcctcatctccgatatcggtcttgctctaatgggaactgctctgtactttgcttccaagcaagttggtgtttcgaccattctcttcctctaccttgttccctacctgtgggttcaccactggctcgttgccattacctacctccaccaccaccacaccgagctccctcactacaccgctgagggctggacctacgtcaagggagctctcgccactgtcgaccgtgagtttggcttcatcggaaagcacctcttccacggtatcattgagaagcacgttgttcaccatctcttccctaagatccccttctacaaggctgacgaggccaccgaggccatcaagcccgtcattggcgaccactactgccacgacgaccgaagcttcctgggccagctgtggaccatcttcggcacgctcaagtacgtcgagcacgaccctgcccgacccggtgccatgcgatggaacaaggactaggctaggcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgc

SEQ ID NO: 56 - DNA, 12403 bp, Artificial Sequence
  the sequence of pKR873
ggtcgactcgacgtacgaaaccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcacaatggcgactcgacagcgaactgccaccactgttgtggtcgaggaccttcccaaggtcactcttgaggccaagtctgaacctgtgttccccgatatcaagaccatcaaggatgccattcccgcgcactgcttccagccctcgctcgtcacctcattctactacgtcttccgcgattttgccatggtctctgccctcgtctgggctgctctcacctacatccccagcatccccgaccagaccctccgcgtcgcagcttggatggtctacggcttcgtccagggtctgttctgcaccggtgtctggattctcggccatgagtgcggccacggtgctttctctctccacggaaaggtcaacaatgtgaccggctggttcctccactcgttcctcctcgtcccctacttcagctggaagtactctcaccaccgccaccaccgcttcaccggccacatggatctcgacatggctttcgtccccaagactgagcccaagccctccaagtcgctcatgattgctggcattgacgtcgccgagcttgttgaggacacccccgctgctcagatggtcaagctcatcttccaccagcttttcggatggcaggcgtacctcttcttcaacgctagctctggcaagggcagcaagcagtgggagcccaagactggcctctccaagtggttccgagtcagtcacttcgagcctaccagcgctgtcttccgccccaacgaggccatcttcatcctcatctccgatatcggtcttgctctaatgggaactgctctgtactttgcttccaagcaagttggtgtttcgaccattctcttcctctaccttgttccctacctgtgggttcaccactggctcgttgccattacctacctccaccaccaccacaccgagctccctcactacaccgctgagggctggacctacgtcaagggagctctcgccactgtcgaccgtgagtttggcttcatcggaaagcacctcttccacggtatcattgagaagcacgttgttcaccatctcttccctaagatccccttctacaaggctgacgaggccaccgaggccatcaagcccgtcattggcgaccactactgccacgacgaccgaagcttcctgggccagctgtggaccatcttcggcacgctcaagtacgtcgagcacgaccctgcccgacccggtgccatgcgatggaacaaggactaggctaggcggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcagcccgggggatccgcccacgtacggtaccatctgctaatattttaaatcacatgcaagagaggaggcatggttccattttctaccttcacattatttgagaaaaacgaacttgttctgtgttttatttttgcccttcacattagtacaacgtggaagactcatggttacacagaatcatacataagtacaatgcttgtccctaagaaaacaagcactcgttgtattgaacctttacggctcatgcggccgcgaattcactagtgattgaattcgcggccgcttagtccgacttggccttggcggccgcggccgactctttgagcgtgaagatctgcgccgtctcgggcacagcgccgtagttgacaaagaggtgcgcggtcttgaagaaggccgtgatgatgggctcgtcgttcctgcgcacgaggtgcgggtacgcggccgcaaagtgcttggtggcttcgttgagcttgtagtgcggaatgatcgggaacaagtggtggacctggtgcgtgccaatgtggtggctcaggttgtccacgaacgcgccgtacgagcggtcgacgctcgagaggttgcccttgacgtacgtccactccgagtcgccgtaccacggcgtcgcttcgtcgttgtggtgcaagaaggtcgtaatgacgaggaacgaagcaaagacaaagagcggcgcatagtagtagaggcccatgacggcaaagccgagcgagtatgtgaggtacgcgtacgcggcgaagaaggcggcccagacgccgagcgacacgatgacggccgacgcgcggcgaaggaggagcgggtcccacgggtcaaagtggctcatcgtgcgcggggcatacccgaccttcaagtagacaaaccacgcaccgccgagcgtgtagacccattggcgcacgtcctggaggtccttgaccgaccggtgcgggtaaaagatctcgtccttatcaatgttgcccgtgttcttgtggtggtggcggtgcgtcacgcgccagctctcgaacggcgtcaaaatcgcagagtgcatgatgcagccgatgataaagttgacgctgtggtagcgcgagaaggccgagtggccgcagtcgtggccgaccgtgaagaagccccagaagatgacgccctgcacgtagatgtaggtggcgcaaacgagcgcgtggagcagaacgttatcggcaatgaacggcgtcgagcgcgccgcgtagagcagcgccgccgaggccgacgcgttgaagatcgcgcgggccgtgtagtagagcgagaggccgaggttcgactcaaagcacgcgttcgggatcgagtgcttgagctccgtgagcgtcgggaactcgaccttcgtcttatcctcagtcatgcggccgctgaagtattgcttcttagttaacctttcctttctctctcagctatgtgaattcattttgctttcgtcacaatttatatagtgaaattggatctttggagttaacgccttcacaggattatcgtgttagaacaatgctttttcatgttctaattagtagtacattacaaatgtgcactctattcaataagcatcttttggcacgttaataaatcatgtgaaaaaaaaatactactatttcaaagaaagtgttgtaaaaagaaacggaaagagagctggcttcagttgttgagacttgtttgctagtaaaaatggtgtgaagagtgattcatggtgaggtggtttttcgtccctttctgtttgcatgaaaaacaaatggcaagagatgacgtaggattccttcccttaacgattatctgtttttaatttcaaatatacatataggaatttatgaattactaaggttgtaaaatatgctggtcatttatttatggctaaaatatttttttttctcgtaaatataaaaatatttaaaatttatttttatcatattttttatccttataaaattatgtgtacaacctatataaaaaaatatcatatttaatattgattatatgtttaatcaatataaaaaatcattatcatatatttagatttattcgaatatacatctaaacaaaaaataacatattttaattttatgaagaaaaaaaaatattttatcctttatttatttaagattaattaatagttatgtattgtggaaagacttttacacatgcaatagatatactgaatcaattagatgccaatgctgagttggaaatcacttgaggaggggaggagacttgccaatgcttttcagtttcatttaaatgatttagtggaggagatagagtagtgataaaggcatgccccaattttggagtgtatatatgagtggaaataagagagggatagagagaaaaaataaagagagtaaaaataattaatgtgaaatgatatgataaaaaaataaagaaagagataaagagaaaaatgaaatgagagatagatgaaatagagagtagatacatgtttgtttaggttttttttaggaaataacacatttttttctcatcacttattactcactgtcaatttcctctctttcaatcataatgatatgatttgtttaacaaaaatgtgaaaaaacatataaagtaaaatatttttataaattgataaataaaaatttacaaaatttatttcttattaaattgaatagaaaatgaaagaaaagaaaagaaaaagtatatataaaatgatatagctttaaaaagaataaatttttcatatcagtctttttttaataatttagaaatatttaagtatatagcaaaaatataatgtactttacatatgcataaataataatttgaaaatagaactaatagaatagagaaaaaagtaatataataattaactatatgaaaatttagaagggacaatatttttaattaagaatataaacaatatttcttttcatgtaatgagggacggatgtacggggccagtgttggagtcaaagccaaaatagtcacggggaaattaatgcactgcatgactattcgaaaaaattcactagccttacttagatgttagattaatagctagggggtgcagataattttgaaaggcatgaaaaacattaatttgtacattgcaagcttttgatgacaagctttgcaattgttcacactaccttatgccatttataaatagagtgattggcatatgaaggaaatcatgagagtcgaagcgaaaaacaaagcttgagagtgtaggaaaaatacagtttttttggtaaaaatacagtatttgaataggagcgaaaaatatcctttcaaaatgatccttttctttttttttttttttcttgttgttcttggtcagttattcaaaggaaaagggattgaaataaaaacttgcatgtgggatcgtacgtcgagtcgacctgca

SEQ ID NO: 57 - DNA, 3983 bp, Artificial Sequence
  the sequence of pKR132
ctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagacctgcaggccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgt

SEQ ID NO: 58 - DNA, 4268 bp, Artificial Sequence
  the sequence of pKR160
aatctagacgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccgcttgctattgatgggtgaagtgaagtgaaggtgggggcatttattgaagttttagggtgttgtagttgcatggaatatggtacgtggaagtgaagtggggtggttttggtgcggtggctgcatttgcttcaatgcttgttaatttacgtgcttccacgtaacatttccatgcatttggtttataaactgattactatcaaacattatatatcattagtataacccacttggcttcacgtaatcatataagatctagtataaaaaaattatttatcttaaaaagaattatgtgtaaaattttcttattcaacggtaaatatatgcggtgagtggaattaatactcaataaattaggaaacactgatttctaacaaaagggaaaaatattcattagcatagagaataataagacaagttgtgtaattgttttttttcctactctagtataataagactaataggattgcgggccaattaatgtgaaatttttttgcttataggtttggaaattaccttgatgaggtttaatttgtcaatggagcaaaaaattgtctttttttggtacatcacgttgaatattattaattaatctaaattaaccgagcagatattgatcacttcgcagtttgcaccatatctttaggggattgaaatcgccagtgtgacaaggcagcaccagatacaacagatcaatttgagtagaatcatactttctgtaacaaataatgaaagtggttaaagcacattttttgtattttttactttttttgttctttcattttagttttttaaaataaagtaaatataagttctgttcttttgtaattatttccttcaaaatttattatttgcaccgcatctatttgtaattatcgcctacttgtcaaactagggtgcacttagtaaatatctggtgcaaataacaaatgcctttattttttgggcacagacagaaacgacatcgttaagccgtgaagcgaaaggaacgaaacggcgtcgtttaatctggagccccaaacgcagttggtttcgtacgtctagaagggctagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgccc

SEQ ID NO: 59 - DNA, 4990 bp, Artificial Sequence
  the sequence of pKR124
  misc_feature (1186)..(1186): n is a, c, g, or t
ctagacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtacgtcgagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcct

SEQ ID NO: 60 - DNA, 3982 bp, Artificial Sequence
  the sequence of pKR163
gtacgaaaccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtcgagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagac

SEQ ID NO: 61 - DNA, 8878 bp, Artificial Sequence
  the sequence of pY34
ggccgcacaggccgcacaatggcgactcgacagcgaactgccaccactgttgtggtcgaggaccttcccaaggtcactcttgaggccaagtctgaacctgtgttccccgatatcaagaccatcaaggatgccattcccgcgcactgcttccagccctcgctcgtcacctcattctactacgtcttccgcgattttgccatggtctctgccctcgtctgggctgctctcacctacatccccagcatccccgaccagaccctccgcgtcgcagcttggatggtctacggcttcgtccagggtctgttctgcaccggtgtctggattctcggccatgagtgcggccacggtgctttctctctccacggaaaggtcaacaatgtgaccggctggttcctccactcgttcctcctcgtcccctacttcagctggaagtactctcaccaccgccaccaccgcttcaccggccacatggatctcgacatggctttcgtccccaagactgagcccaagccctccaagtcgctcatgattgctggcattgacgtcgccgagcttgttgaggacacccccgctgctcagatggtcaagctcatcttccaccagcttttcggatggcaggcgtacctcttcttcaacgctagctctggcaagggcagcaagcagtgggagcccaagactggcctctccaagtggttccgagtcagtcacttcgagcctaccagcgctgtcttccgccccaacgaggccatcttcatcctcatctccgatatcggtcttgctctaatgggaactgctctgtactttgcttccaagcaagttggtgtttcgaccattctcttcctctaccttgttccctacctgtgggttcaccactggctcgttgccattacctacctccaccaccaccacaccgagctccctcactacaccgctgagggctggacctacgtcaagggagctctcgccactgtcgaccgtgagtttggcttcatcggaaagcacctcttccacggtatcattgagaagcacgttgttcaccatctcttccctaagatccccttctacaaggctgacgaggccaccgaggccatcaagcccgtcattggcgaccactactgccacgacgaccgaagcttcctgggccagctgtggaccatcttcggcacgctcaagtacgtcgagcacgaccctgcccgacccggtgccatgcgatggaacaaggactaggctaggcggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaattccacacaacgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaataatttgaatcgaatcggagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccaaacaccactaaaaccccacaaaatatatcttaccgaatatacagtaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtatttaaatgatgtcgacgcagtaggatgtcctgcacgggtctttttgtggggtgtggagaaaggggtgcttggagatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgccatggaaccttgcggatatcgatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaatccgc

SEQ ID NO: 62 - DNA, 5207 bp, Artificial Sequence
  the sequence of pKR863
ggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtcgagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagacgtacgaaaccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcacaatggcgactcgacagcgaactgccaccactgttgtggtcgaggaccttcccaaggtcactcttgaggccaagtctgaacctgtgttccccgatatcaagaccatcaaggatgccattcccgcgcactgcttccagccctcgctcgtcacctcattctactacgtcttccgcgattttgccatggtctctgccctcgtctgggctgctctcacctacatccccagcatccccgaccagaccctccgcgtcgcagcttggatggtctacggcttcgtccagggtctgttctgcaccggtgtctggattctcggccatgagtgcggccacggtgctttctctctccacggaaaggtcaacaatgtgaccggctggttcctccactcgttcctcctcgtcccctacttcagctggaagtactctcaccaccgccaccaccgcttcaccggccacatggatctcgacatggctttcgtccccaagactgagcccaagccctccaagtcgctcatgattgctggcattgacgtcgccgagcttgttgaggacacccccgctgctcagatggtcaagctcatcttccaccagcttttcggatggcaggcgtacctcttcttcaacgctagctctggcaagggcagcaagcagtgggagcccaagactggcctctccaagtggttccgagtcagtcacttcgagcctaccagcgctgtcttccgccccaacgaggccatcttcatcctcatctccgatatcggtcttgctctaatgggaactgctctgtactttgcttccaagcaagttggtgtttcgaccattctcttcctctaccttgttccctacctgtgggttcaccactggctcgttgccattacctacctccaccaccaccacaccgagctccctcactacaccgctgagggctggacctacgtcaagggagctctcgccactgtcgaccgtgagtttggcttcatcggaaagcacctcttccacggtatcattgagaagcacgttgttcaccatctcttccctaagatccccttctacaaggctgacgaggccaccgaggccatcaagcccgtcattggcgaccactactgccacgacgaccgaagcttcctgggccagctgtggaccatcttcggcacgctcaagtacgtcgagcacgaccctgcccgacccggtgccatgcgatggaacaaggactaggctaggc

SEQ ID NO: 63 - DNA, 9035 bp, Artificial Sequence
  the sequence of pKR88=69
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggtcgactcgacgtacgaaaccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcacaatggcgactcgacagcgaactgccaccactgttgtggtcgaggaccttcccaaggtcactcttgaggccaagtctgaacctgtgttccccgatatcaagaccatcaaggatgccattcccgcgcactgcttccagccctcgctcgtcacctcattctactacgtcttccgcgattttgccatggtctctgccctcgtctgggctgctctcacctacatccccagcatccccgaccagaccctccgcgtcgcagcttggatggtctacggcttcgtccagggtctgttctgcaccggtgtctggattctcggccatgagtgcggccacggtgctttctctctccacggaaaggtcaacaatgtgaccggctggttcctccactcgttcctcctcgtcccctacttcagctggaagtactctcaccaccgccaccaccgcttcaccggccacatggatctcgacatggctttcgtccccaagactgagcccaagccctccaagtcgctcatgattgctggcattgacgtcgccgagcttgttgaggacacccccgctgctcagatggtcaagctcatcttccaccagcttttcggatggcaggcgtacctcttcttcaacgctagctctggcaagggcagcaagcagtgggagcccaagactggcctctccaagtggttccgagtcagtcacttcgagcctaccagcgctgtcttccgccccaacgaggccatcttcatcctcatctccgatatcggtcttgctctaatgggaactgctctgtactttgcttccaagcaagttggtgtttcgaccattctcttcctctaccttgttccctacctgtgggttcaccactggctcgttgccattacctacctccaccaccaccacaccgagctccctcactacaccgctgagggctggacctacgtcaagggagctctcgccactgtcgaccgtgagtttggcttcatcggaaagcacctcttccacggtatcattgagaagcacgttgttcaccatctcttccctaagatccccttctacaaggctgacgaggccaccgaggccatcaagcccgtcattggcgaccactactgccacgacgaccgaagcttcctgggccagctgtggaccatcttcggcacgctcaagtacgtcgagcacgaccctgcccgacccggtgccatgcgatggaacaaggactaggctaggcggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgc

SEQ ID NO: 64 - DNA, 5108 bp, Artificial Sequence
  the sequence of pKR270
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatggagtcgattgcgccattcctcccatcaaagatgccgcaagatctgtttatggaccttgccaccgctatcggtgtccgggccgcgccctatgtcgatcctctcgaggccgcgctggtggcccaggccgagaagtacatccccacgattgtccatcacacgcgtgggttcctggtcgcggtggagtcgcctttggcccgtgagctgccgttgatgaacccgttccacgtgctgttgatcgtgctcgcttatttggtcacggtctttgtgggcatgcagatcatgaagaactttgagcggttcgaggtcaagacgttttcgctcctgcacaacttttgtctggtctcgatcagcgcctacatgtgcggtgggatcctgtacgaggcttatcaggccaactatggactgtttgagaacgctgctgatcataccttcaagggtcttcctatggccaagatgatctggctcttctacttctccaagatcatggagtttgtcgacaccatgatcatggtcctcaagaagaacaaccgccagatctccttcttgcacgtttaccaccacagctccatcttcaccatctggtggttggtcacctttgttgcacccaacggtgaagcctacttctctgctgcgttgaactcgttcatccatgtgatcatgtacggctactacttcttgtcggccttgggcttcaagcaggtgtcgttcatcaagttctacatcacgcgctcgcagatgacacagttctgcatgatgtcggtccagtcttcctgggacatgtacgccatgaaggtccttggccgccccggataccccttcttcatcacggctctgctttggttctacatgtggaccatgctcggtctcttctacaacttttacagaaagaacgccaagttggccaagcaggccaaggccgacgctgccaaggagaaggcaaggaagttgcagtaagc

SEQ ID NO: 65 - DNA, 792 bp, Artificial Sequence
  IgD9e: synthetic delta-9 elongase derived from Isochrysis galbana codon-optimized for expression in Yarrowia lipolytica
atggctctggccaacgacgctggcgagcgaatctgggctgccgtcaccgatcccgaaatcctcattggcaccttctcctacctgctcctgaagcctctcctgcgaaactctggtctcgtggacgagaagaaaggagcctaccgaacctccatgatctggtacaacgtcctcctggctctcttctctgccctgtccttctacgtgactgccaccgctctcggctgggactacggtactggagcctggctgcgaagacagaccggtgatactccccagcctctctttcagtgtccctctcctgtctgggactccaagctgttcacctggactgccaaggccttctactattctaagtacgtggagtacctcgacaccgcttggctggtcctcaagggcaagcgagtgtcctttctgcaggccttccatcactttggagctccctgggacgtctacctcggcattcgactgcacaacgagggtgtgtggatcttcatgttctttaactcgttcattcacaccatcatgtacacctactatggactgactgccgctggctacaagttcaaggccaagcctctgatcactgccatgcagatttgccagttcgtcggtggctttctcctggtctgggactacatcaacgttccctgcttcaactctgacaagggcaagctgttctcctgggctttcaactacgcctacgtcggatctgtctttctcctgttctgtcacttcttttaccaggacaacctggccaccaagaaatccgctaaggctggtaagcagctttag

SEQ ID NO: 66 - DNA, 101 bp, Artificial Sequence
  primer IL3-1A
gccaacgacgctggcgagcgaatctgggctgccgtcaccgatcccgaaatcctcattggcaccttctcctacctgctcctgaagcctctcctgcgaaactc

SEQ ID NO: 67 - DNA, 101 bp, Artificial Sequence
  primer IL3-1B
accagagtttcgcaggagaggcttcaggagcaggtaggagaaggtgccaatgaggatttcgggatcggtgacggcagcccagattcgctcgccagcgtcgt

SEQ ID NO: 68 - DNA, 100 bp, Artificial Sequence
  primer IL3-2A
tggtctcgtggacgagaagaaaggagcctaccgaacctccatgatctggtacaacgtcctcctggctctcttctctgccctgtccttctacgtgactgcc

SEQ ID NO: 69 - DNA, 100 bp, Artificial Sequence
  primer IL3-2B
cggtggcagtcacgtagaaggacagggcagagaagagagccaggaggacgttgtaccagatcatggaggttcggtaggctcctttcttctcgtccacgag

SEQ ID NO: 70 - DNA, 100 bp, Artificial Sequence
  primer IL3-3A
accgctctcggctgggactacggtactggagcctggctgcgaagacagaccggtgatactccccagcctctctttcagtgtccctctcctgtctgggact

SEQ ID NO: 71 - DNA, 100 bp, Artificial Sequence
  primer IL3-3B
ttggagtcccagacaggagagggacactgaaagagaggctggggagtatcaccggtctgtcttcgcagccaggctccagtaccgtagtcccagccgagag

SEQ ID NO: 72 - DNA, 100 bp, Artificial Sequence
  primer IL3-4A
ccaagctgttcacctggactgccaaggccttctactattctaagtacgtggagtacctcgacaccgcttggctggtcctcaagggcaagcgagtgtcctt

SEQ ID NO: 73 - DNA, 100 bp, Artificial Sequence
  primer IL3-4B
cagaaaggacactcgcttgcccttgaggaccagccaagcggtgtcgaggtactccacgtacttagaatagtagaaggccttggcagtccaggtgaacagc

SEQ ID NO: 74 - DNA, 89 bp, Artificial Sequence
  primer IL3-5A
ttccatcactttggagctccctgggacgtctacctcggcattcgactgcacaacgagggtgtgtggatcttcatgttctttaactcgtt

SEQ ID NO: 75 - DNA, 89 bp, Artificial Sequence
  primer IL3-5B
aatgaacgagttaaagaacatgaagatccacacaccctcgttgtgcagtcgaatgccgaggtagacgtcccagggagctccaaagtgat

SEQ ID NO: 76 - DNA, 91 bp, Artificial Sequence
  primer IL3-6A
cattcacaccatcatgtacacctactatggactgactgccgctggctacaagttcaaggccaagcctctgatcactgccatgcagatttgc

SEQ ID NO: 77 - DNA, 91 bp, Artificial Sequence
  primer IL3-6B
actggcaaatctgcatggcagtgatcagaggcttggccttgaacttgtagccagcggcagtcagtccatagtaggtgtacatgatggtgtg

SEQ ID NO: 78 - DNA, 94 bp, Artificial Sequence
  primer IL3-7A
cagttcgtcggtggctttctcctggtctgggactacatcaacgttccctgcttcaactctgacaagggcaagctgttctcctgggctttcaact

SEQ ID NO: 79 - DNA, 94 bp, Artificial Sequence
  primer IL3-7B
gcgtagttgaaagcccaggagaacagcttgcccttgtcagagttgaagcagggaacgttgatgtagtcccagaccaggagaaagccaccgacga

SEQ ID NO: 80 - DNA, 91 bp, Artificial Sequence
  primer IL3-8A
acgcctacgtcggatctgtctttctcctgttctgtcacttcttttaccaggacaacctggccaccaagaaatccgctaaggctggtaagca

SEQ ID NO: 81 - DNA, 91 bp, Artificial Sequence
  primer IL3-8B
aagctgcttaccagccttagcggatttcttggtggccaggttgtcctggtaaaagaagtgacagaacaggagaaagacagatccgacgtag

SEQ ID NO: 82 - DNA, 41 bp, Artificial Sequence
  primer IL3-1F
tttccatggctctggccaacgacgctggcgagcgaatctgg

SEQ ID NO: 83 - DNA, 36 bp, Artificial Sequence
  Primer IL3-4R
tttctgcagaaaggacactcgcttgcccttgaggac

SEQ ID NO: 84 - DNA, 41 bp, Artificial Sequence
  primer IL3-5F
tttctgcaggccttccatcactttggagctccctgggacgt

SEQ ID NO: 85 - DNA, 42 bp, Artificial Sequence
  primer IL3-8R
tttgcggccgctaaagctgcttaccagccttagcggatttct

SEQ ID NO: 86 - DNA, 417 bp, Artificial Sequence
  417 bp NcoI/PstI fragment pT9(1-4)
catggctctggccaacgacgctggcgagcgaatctgggctgccgtcaccgatcccgaaatcctcattggcaccttctcctacctgctcctgaagcctctcctgcgaaactctggtctcgtggacgagaagaaaggagcctaccgaacctccatgatctggtacaacgtcctcctggctctcttctctgccctgtccttctacgtgactgccaccgctctcggctgggactacggtactggagcctggctgcgaagacagaccggtgatactccccagcctctctttcagtgtccctctcctgtctgggactccaagctgttcacctggactgccaaggccttctactattctaagtacgtggagtacctcgacaccgcttggctggtcctcaagggcaagcgagtgtcctttctgca

SEQ ID NO: 87 - DNA, 377 bp, Artificial Sequence
  377 bp PstI/Not1 fragment pT9(5-8)
ggccttccatcactttggagctccctgggacgtctacctcggcattcgactgcacaacgagggtgtgtggatcttcatgttctttaactcgttcattcacaccatcatgtacacctactatggactgactgccgctggctacaagttcaaggccaagcctctgatcactgccatgcagatttgccagttcgtcggtggctttctcctggtctgggactacatcaacgttccctgcttcaactctgacaagggcaagctgttctcctgggctttcaactacgcctacgtcggatctgtctttctcctgttctgtcacttcttttaccaggacaacctggccaccaagaaatccgctaaggctggtaagcagctttagc

SEQ ID NO: 88 - DNA, 1341 bp, Mortierella alpina
atgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtag

SEQ ID NO: 89 - DNA, 9472 bp, Artificial Sequence
  sequence of pDMW263
catggcatggatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccgggatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttacgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaagtgcacgggaatatttcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgattaattaactagagcggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaataatttgaatcgaatcggagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccaaacaccactaaaaccccacaaaatatatcttaccgaatatacagtaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtac

SEQ ID NO: 90 - DNA, 777 bp, Artificial Sequence
  synthetic delta-9 elongase derived from Euglena gracilis codon-optimized for expression in Yarrowia lipolytica
atggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 91 - DNA, 11740 bp, Artificial Sequence
  sequence of pKR920
  misc_feature (10565)..(10565): n is a, c, g, or t
gtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcgaattcactagtgattccttatagagccttccccgcgggttgcttctccgccatccgggcgaacaccgccagatagcgcagcaggatgaccaacccttcatggggcagcgggttccgatacggcaggttgtgcttctggcacagctgttccacctggtagctaaccgctgtcaggttgtggcgagggagggtcggccacaaatggtgctcaatctggtaattcaagcctccgaaaaaccaatctgtgataatccctcgccgaatgttcatggtctcatggatctggccaaccgagaatccatggccatcccagactgagtccccgatcttctccagtgggtagtggttcatgaacaccacgatcgcaatgccgaagccgccaaccagctccgaaacgaaaaacaccaacagcgatgtgaggatgctgggcataaagaataagtggaacagggtcttcaaggtccagtgcagggcgaggccaatggcctccttcttatactgagagcgatagaattggttatctctgtccttcaaactgcgcacggtcaacacgctctggaaacaccaaatgaaccgcaacaagatacagatgaccaagaaatagtactgctggaactgaatgagcttgcgggaaatcggtgacgcccgtgtgacgtcatcctcagaccaggctaagagggggaggttgtcaatatcagggtcgtgcccttgaacattggttgccgaatgatgtgcattgtgtctgtccttccaccatgtcacggaaaaaccttgcagaccattgccaaataccagtcccacgaggttgttccagttccggttcttgaaagtctggtggtggcaaatgtcatgagaaagccagcccatctgttgatagtgcatcccaagcaacactgccccaatgaaatacatctgatactgaaccatcaggaaataacccagcactccaaggcccagtgtggtgctgattttgtatgagtaccagaggggggaggcatcaaacatgccagttgcgatcaactcttctcggagcttccggaaatcctcttgagcttcattcactgcagcctggggtggcaactcagaactgggattgattttgggcatgcgcttgagcttgtcgaaggcttcttgagagtgcataaccatgaaggcatcagtggcatcccttccttggtaattctctataatttccgcaccaccagggtggaaattgacccaggcagacacatcatatgttgttccatcaattgtaaggggaagcgcttggcgctttgacttcatttcaatcgaattcccgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 92 - DNA, 1098 bp, Artificial Sequence
  sequence of fragment cal a24-4
aggatcctgcaggcagccaagaaggttttggagcgagttccaatctcaaaaccgccattcgaatacaatgatctgaagaaagcagtaccaccacattgtttttcacgaccactttcccgatccttgtatttcctctttcacgacattattgtaacatgtatccttttctacgtagcatcaaactacattcatatgctccctcgtttcctttcctgcatcgtatggcctgtttactggatctcccaaggagtttttctcggcagattgtggatgatcggccacgaatgcggtcatcatagcttcagtaattaccgttgggtcgacgatacagtcggttttctaatccatacggccaccctcactccctatttttccttcaaatatagccaccgtaatcaccatgcacacaccaattccatggaatacgacgaggttcatatcccgaaacgcaaatcagaagctctctactttgaatttctgggcaacaacccaatcggcttaatgatcaccatgctatgtaaactgactttcggatatgcagcttacattatgttcaattacacaggtaagaagcacaaatctgggggcttagcgagccacttctacccacaaagccctctctttaacgacagcgaacgtaaccatgttttgttctctgacatcgggatttgcatcgtcttgtacgcgtgttaccgtattgtgacggtcacaggggcaatgccggcattttatgtgtacggtattccttgggttataatgagtgctattctctttgcagcaacttatttacaacacactcatccttcaatccctcattatgatacaacggagtggaactggcttagaggggctttatcgacaattgatagagatttagggttcttcaacatgaacaaaacacattatcatgttatccaccatttgtttcctgtcattccggaataccatgcacaagaggcaaccgaggccatcaagcccatcttaggtcaatattacaagtatgatggtactccgtttctaaaggccttgtggagagaaatgaaggagtgtatttatgtagaatccgatgaaggtcagaagaaacctgcaggagatctt

SEQ ID NO: 93 - DNA, 30 bp, Artificial Sequence
  sequence of the oCal-15 primer
aggatcctgcaggcagccaagaaggttttg

SEQ ID NO: 94 - DNA, 29 bp, Artificial Sequence
  sequence of the oCal-6 primer
aagatctcctgcaggtttcttctgacctc

SEQ ID NO: 95 - DNA, 8138 bp, Artificial Sequence
  sequence of pKR53B
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatctcctgcaggtttcttctgaccttcatcggattctacataaatacactccttcatttctctccacaaggcctttagaaacggagtaccatcatacttgtaatattgacctaagatgggcttgatggcctcggttgcctcttgtgcatggtattccggaatgacaggaaacaaatggtggataacatgataatgtgttttgttcatgttgaagaaccctaaatctctatcaattgtcgataaagcccctctaagccagttccactccgttgtatcataatgagggattgaaggatgagtgtgttgtaaataagttgctgcaaagagaatagcactcattataacccaaggaataccgtacacataaaatgccggcattgcccctgtgaccgtcacaatacggtaacacgcgtacaagacgatgcaaatcccgatgtcagagaacaaaacatggttacgttcgctgtcgttaaagagagggctttgtgggtagaagtggctcgctaagcccccagatttgtgcttcttacctgtgtaattgaacataatgtaagctgcatatccgaaagtcagtttacatagcatggtgatcattaagccgattgggttgttgcccagaaattcaaagtagagagcttctgatttgcgtttcgggatatgaacctcgtcgtattccatggaattggtgtgtgcatggtgattacggtggctatatttgaaggaaaaatagggagtgagggtggccgtatggattagaaaaccgactgtatcgtcgacccaacggtaattactgaagctatgatgaccgcattcgtggccgatcatccacaatctgccgagaaaaactccttgggagatccagtaaacaggccatacgatgcaggaaaggaaacgagggagcatatgaatgtagtttgatgctacgtagaaaaggatacatgttacaataatgtcgtgaaagaggaaatacaaggatcgggaaagtggtcgtgaaaaacaatgtggtggtactgctttcttcagatcattgtattcgaatggcggttttgagattggaactcgctccaaaaccttcttggctgcctgcag

SEQ ID NO: 96 - DNA, 7085 bp, Artificial Sequence
  sequence of pKR85
cgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatctcctgcaggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacgg

SEQ ID NO: 97 - DNA, 22 bp, Artificial Sequence
  sequence of the oKR85-1 primer
actcgaggcgcgccgtcgacgg

SEQ ID NO: 98 - DNA, 18 bp, Artificial Sequence
  sequence of the oKR85-2 primer
aagatctggcgcgccaag

SEQ ID NO: 99 - DNA, 4827 bp, Artificial Sequence
  sequence of pPCR85
actcgaggcgcgccgtcgacggatccgtacgagatccggccggccagatcctgcaggagatccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggcgcgccagatcttgggctagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgccc

SEQ ID NO: 100 - DNA, 15114 bp, Artificial Sequence
  sequence of pKR91
gatctggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatctcctgcaggatctggccggccggatctcgtacggatccgtcgacggcgcgcctcgagtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggatcgatccatcgcgatgtaccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtagttcgatgttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcgatccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccccgcaagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagcgtgtcgtgctccaccatgttgacgaagattttcttcttgtcattgagtcgtaagagactctgtatgaactgttcgccagtctttacggcgagttctgttaggtcctctatttgaatctttgactccatggcctttgattcagtgggaactacctttttagagactccaatctctattacttgccttggtttgtgaagcaagccttgaatcgtccatactggaatagtacttctgatcttgagaaatatatctttctctgtgttcttgatgcagttagtcctgaatcttttgactgcatctttaaccttcttgggaaggtatttgatctcctggagattattgctcgggtagatcgtcttgatgagacctgctgcgtaagcctctctaaccatctgtgggttagcattctttctgaaattgaaaaggctaatcttctcattatcagtggtgaacatggtatcgtcaccttctccgtcgaacttcctgactagatcgtagagatagaggaagtcgtccattgtgatctctggggcaaaggagatctgaattaattcgatatggtggatttatcacaaatgggacccgccgccgacagaggtgtgatgttaggccaggactttgaaaatttgcgcaactatcgtatagtggccgacaaattgacgccgagttgacagactgcctagcatttgagtgaattatgtgaggtaatgggctacactgaattggtagctcaaactgtcagtatttatgtatatgagtgtatattttcgcataatctcagaccaatctgaagatgaaatgggtatctgggaatggcgaaatcaaggcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggtccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaagggaacgcatgaagttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaagacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcaattcggtcgatatggctattacgaagaaggctcgtgcgcggagtcccgtgaactttcccacgcaacaagtgaaccgcaccgggtttgccggaggccatttcgttaaaatgcgcagccatggctgcttcgtccagcatggcgtaatactgatcctcgtcttcggctggcggtatattgccgatgggcttcaaaagccgccgtggttgaaccagtctatccattccaaggtagcgaactcgaccgcttcgaagctcctccatggtccacgccgatgaatgacctcggccttgtaaagaccgttgatcgcttctgcgagggcgttgtcgtgctgtcgccgacgcttccgatagatggctcgatacctgcttctgccaaccgctcggaatagcgaaaggacacgtattgaacaccgcgatccgagtgatgcactaggccgccatgagcgggacgccgatcatgatgagcctcctcgagggcatcgaggacaaagcctgcatgtgctgtccggctcgcccgccatccgacaatgcgacgggcgaagacgtcgatcacgaaggccacgtagacgaagccctcccaagtggcgacataagtacggacatgcgcaaaggctttcccggtttgtcgctgatggtgcaagagacgctgaagcgcgatccgatgcgcaggcatctgttcgtcttccgcggtcgtggcggtggcctgatcaaggtcactcgccgaagagctgcatgattggctcgaaaccgagcgggggaaattgtcgcgcagttctcccgtcgccgaggcgataaattacatgctcaagcgatgggatggcattacgtcattcctcgatgacggcccgatttgcctgacgaacaatgctgccgaacgaacgctcagaggctatgtactcggcaggaagtcatggctgtttgccggatcggatcgttgtgctgaacgtgcggcgttcatggcgacactgatcatgagcgccaagctcaataacatcgatccgcaggcctggcttgccgacgtccgcgccgaccttgcggacgctccgatcagcaggcttgagcaacagctgccgtggaactggacatccaagacactgagtgctcaggcggcctgacctgcggccttcaccggatacttaccccattatcgcagattgcgatgaagcatcagcgtcattcagcaatcttgccaaagtatgcaggctcgcgagaatcgacgtgcgaaaccggctggttgcgccaaagatccgcttgcggagcggtcgaacattcatgctgggacttcaagaggtcgagtagaggaagaaccggaaaggttgcaccggaaaatatgcgttcctttggagagcgcctcatggacgtgaacaaatcgcccggaccaaggatgccacggatacaaaagctcgcgaagctcggtcccgtgggtgttctgtcgtctcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcgatccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagag

SEQ ID NO: 101 - DNA, 13268 bp, Artificial Sequence
  sequence of pKR92
cgcgcctcgagtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggatcgatccatcgcgatgtaccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtagttcgatgttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcgatccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccccgcaagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagcgtgtcgtgctccaccatgttgacgaagattttcttcttgtcattgagtcgtaagagactctgtatgaactgttcgccagtctttacggcgagttctgttaggtcctctatttgaatctttgactccatggcctttgattcagtgggaactacctttttagagactccaatctctattacttgccttggtttgtgaagcaagccttgaatcgtccatactggaatagtacttctgatcttgagaaatatatctttctctgtgttcttgatgcagttagtcctgaatcttttgactgcatctttaaccttcttgggaaggtatttgatctcctggagattattgctcgggtagatcgtcttgatgagacctgctgcgtaagcctctctaaccatctgtgggttagcattctttctgaaattgaaaaggctaatcttctcattatcagtggtgaacatggtatcgtcaccttctccgtcgaacttcctgactagatcgtagagatagaggaagtcgtccattgtgatctctggggcaaaggagtctgaattaattcgatatggtggatttatcacaaatgggacccgccgccgacagaggtgtgatgttaggccaggactttgaaaatttgcgcaactatcgtatagtggccgacaaattgacgccgagttgacagactgcctagcatttgagtgaattatgtgaggtaatgggctacactgaattggtagctcaaactgtcagtatttatgtatatgagtgtatattttcgcataatctcagaccaatctgaagatgaaatgggtatctgggaatggcgaaatcaaggcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggtccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaagggaacgcatgaagttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaagacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcaattcggtcgatatggctattacgaagaaggctcgtgcgcggagtcccgtgaactttcccacgcaacaagtgaaccgcaccgggtttgccggaggccatttcgttaaaatgcgcagccatggctgcttcgtccagcatggcgtaatactgatcctcgtcttcggctggcggtatattgccgatgggcttcaaaagccgccgtggttgaaccagtctatccattccaaggtagcgaactcgaccgcttcgaagctcctccatggtccacgccgatgaatgacctcggccttgtaaagaccgttgatcgcttctgcgagggcgttgtcgtgctgtcgccgacgcttccgatagatggctcgatacctgcttctgccaaccgctcggaatagcgaaaggacacgtattgaacaccgcgatccgagtgatgcactaggccgccatgagcgggacgccgatcatgatgagcctcctcgagggcatcgaggacaaagcctgcatgtgctgtccggctcgcccgccatccgacaatgcgacgggcgaagacgtcgatcacgaaggccacgtagacgaagccctcccaagtggcgacataagtacggacatgcgcaaaggctttcccggtttgtcgctgatggtgcaagagacgctgaagcgcgatccgatgcgcaggcatctgttcgtcttccgcggtcgtggcggtggcctgatcaaggtcactcgccgaagagctgcatgattggctcgaaaccgagcgggggaaattgtcgcgcagttctcccgtcgccgaggcgataaattacatgctcaagcgatgggatggcattacgtcattcctcgatgacggcccgatttgcctgacgaacaatgctgccgaacgaacgctcagaggctatgtactcggcaggaagtcatggctgtttgccggatcggatcgttgtgctgaacgtgcggcgttcatggcgacactgatcatgagcgccaagctcaataacatcgatccgcaggcctggcttgccgacgtccgcgccgaccttgcggacgctccgatcagcaggcttgagcaacagctgccgtggaactggacatccaagacactgagtgctcaggcggcctgacctgcggccttcaccggatacttaccccattatcgcagattgcgatgaagcatcagcgtcattcagcaatcttgccaaagtatgcaggctcgcgagaatcgacgtgcgaaaccggctggttgcgccaaagatccgcttgcggagcggtcgaacattcatgctgggacttcaagaggtcgagtagaggaagaaccggaaaggttgcaccggaaaatatgcgttcctttggagagcgcctcatggacgtgaacaaatcgcccggaccaaggatgccacggatacaaaagctcgcgaagctcggtcccgtgggtgttctgtcgtctcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcgatccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatctgg

SEQ ID NO: 102 - DNA, 15901 bp, Artificial Sequence
  sequence of pKR926
cgcgcctcgagtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggatcgatccatcgcgatgtaccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtagttcgatgttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcgatccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccccgcaagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagcgtgtcgtgctccaccatgttgacgaagattttcttcttgtcattgagtcgtaagagactctgtatgaactgttcgccagtctttacggcgagttctgttaggtcctctatttgaatctttgactccatggcctttgattcagtgggaactacctttttagagactccaatctctattacttgccttggtttgtgaagcaagccttgaatcgtccatactggaatagtacttctgatcttgagaaatatatctttctctgtgttcttgatgcagttagtcctgaatcttttgactgcatctttaaccttcttgggaaggtatttgatctcctggagattattgctcgggtagatcgtcttgatgagacctgctgcgtaagcctctctaaccatctgtgggttagcattctttctgaaattgaaaaggctaatcttctcattatcagtggtgaacatggtatcgtcaccttctccgtcgaacttcctgactagatcgtagagatagaggaagtcgtccattgtgatctctggggcaaaggagtctgaattaattcgatatggtggatttatcacaaatgggacccgccgccgacagaggtgtgatgttaggccaggactttgaaaatttgcgcaactatcgtatagtggccgacaaattgacgccgagttgacagactgcctagcatttgagtgaattatgtgaggtaatgggctacactgaattggtagctcaaactgtcagtatttatgtatatgagtgtatattttcgcataatctcagaccaatctgaagatgaaatgggtatctgggaatggcgaaatcaaggcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggtccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaagggaacgcatgaagttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaagacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcaattcggtcgatatggctattacgaagaaggctcgtgcgcggagtcccgtgaactttcccacgcaacaagtgaaccgcaccgggtttgccggaggccatttcgttaaaatgcgcagccatggctgcttcgtccagcatggcgtaatactgatcctcgtcttcggctggcggtatattgccgatgggcttcaaaagccgccgtggttgaaccagtctatccattccaaggtagcgaactcgaccgcttcgaagctcctccatggtccacgccgatgaatgacctcggccttgtaaagaccgttgatcgcttctgcgagggcgttgtcgtgctgtcgccgacgcttccgatagatggctcgatacctgcttctgccaaccgctcggaatagcgaaaggacacgtattgaacaccgcgatccgagtgatgcactaggccgccatgagcgggacgccgatcatgatgagcctcctcgagggcatcgaggacaaagcctgcatgtgctgtccggctcgcccgccatccgacaatgcgacgggcgaagacgtcgatcacgaaggccacgtagacgaagccctcccaagtggcgacataagtacggacatgcgcaaaggctttcccggtttgtcgctgatggtgcaagagacgctgaagcgcgatccgatgcgcaggcatctgttcgtcttccgcggtcgtggcggtggcctgatcaaggtcactcgccgaagagctgcatgattggctcgaaaccgagcgggggaaattgtcgcgcagttctcccgtcgccgaggcgataaattacatgctcaagcgatgggatggcattacgtcattcctcgatgacggcccgatttgcctgacgaacaatgctgccgaacgaacgctcagaggctatgtactcggcaggaagtcatggctgtttgccggatcggatcgttgtgctgaacgtgcggcgttcatggcgacactgatcatgagcgccaagctcaataacatcgatccgcaggcctggcttgccgacgtccgcgccgaccttgcggacgctccgatcagcaggcttgagcaacagctgccgtggaactggacatccaagacactgagtgctcaggcggcctgacctgcggccttcaccggatacttaccccattatcgcagattgcgatgaagcatcagcgtcattcagcaatcttgccaaagtatgcaggctcgcgagaatcgacgtgcgaaaccggctggttgcgccaaagatccgcttgcggagcggtcgaacattcatgctgggacttcaagaggtcgagtagaggaagaaccggaaaggttgcaccggaaaatatgcgttcctttggagagcgcctcatggacgtgaacaaatcgcccggaccaaggatgccacggatacaaaagctcgcgaagctcggtcccgtgggtgttctgtcgtctcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcgatccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatctggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctcactgaatctttttggctcccttgtgcttcctgacgatatacgtttgcacatagaaattcaagaacaaacacaagactgtgccaacataaaagtaattgaagaaccagccaaacatcctcatcccatcttggcgataacagggaatgttcctgtacttccagacaatgtagaaaccaacattgaattgaatgatctgcattgatgtaatcagggattttggcatggggaacttcagcttgatcaatctggtccaataataaccgtacatgatccagtggatgaaaccattcaacagcacaaaaatccaaacagcttcatttcggtaattatagaacagccacatatccatcggtgcccccaaatgatggaagaattgcaaccaggtcagaggcttgcccatcagtggcaaatagaaggagtcaatatactccaggaacttgctcaaatagaacaactgcgtggtgatcctgaagacgttgttgtcaaaagccttctcgcagttgtcagacataacaccgatggtgtacatggcatatgccattgagaggaatgatcccaacgaataaatggacatgagaaggttgtaattggtgaaaacaaacttcatacgagactgaccttttggaccaagggggccaagagtgaacttcaagatgacaaatgcgatggacaagtaaagcacctcacagtgactggcatcactccagagttgggcataatcaactttgggtaaaacttcctgcccaattgagactatttcattcaccacctccatggtgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggatctggccggccggatctcgtacggatccgtcgacgg

SEQ ID NO: 103 - DNA, 5561 bp, Artificial Sequence; identical to SEQ ID NO: 45
  sequence of pKR767

SEQ ID NO: 104 - DNA, 11889 bp, Artificial Sequence
  sequence of pKR916
  misc_feature (7810)..(7810): n is a, c, g, or t
ggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcgaattcactagtgattccttatagagccttccccgcgggttgcttctccgccatccgggcgaacaccgccagatagcgcagcaggatgaccaacccttcatggggcagcgggttccgatacggcaggttgtgcttctggcacagctgttccacctggtagctaaccgctgtcaggttgtggcgagggagggtcggccacaaatggtgctcaatctggtaattcaagcctccgaaaaaccaatctgtgataatccctcgccgaatgttcatggtctcatggatctggccaaccgagaatccatggccatcccagactgagtccccgatcttctccagtgggtagtggttcatgaacaccacgatcgcaatgccgaagccgccaaccagctccgaaacgaaaaacaccaacagcgatgtgaggatgctgggcataaagaataagtggaacagggtcttcaaggtccagtgcagggcgaggccaatggcctccttcttatactgagagcgatagaattggttatctctgtccttcaaactgcgcacggtcaacacgctctggaaacaccaaatgaaccgcaacaagatacagatgaccaagaaatagtactgctggaactgaatgagcttgcgggaaatcggtgacgcccgtgtgacgtcatcctcagaccaggctaagagggggaggttgtcaatatcagggtcgtgcccttgaacattggttgccgaatgatgtgcattgtgtctgtccttccaccatgtcacggaaaaaccttgcagaccattgccaaataccagtcccacgaggttgttccagttccggttcttgaaagtctggtggtggcaaatgtcatgagaaagccagcccatctgttgatagtgcatcccaagcaacactgccccaatgaaatacatctgatactgaaccatcaggaaataacccagcactccaaggcccagtgtggtgctgattttgtatgagtaccagaggggggaggcatcaaacatgccagttgcgatcaactcttctcggagcttccggaaatcctcttgagcttcattcactgcagcctggggtggcaactcagaactgggattgattttgggcatgcgcttgagcttgtcgaaggcttcttgagagtgcataaccatgaaggcatcagtggcatcccttccttggtaattctctataatttccgcaccaccagggtggaaattgacccaggcagacacatcatatgttgttccatcaattgtaaggggaagcgcttggcgctttgacttcatttcaatcgaattcccgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgagatccggccggccagatcctgcaggtctcaatagattaagaagttggcgtctcattgattgaccatgggggatcctctagacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgcctactcttccttgggacggagtccaagaacacgcaagtgctccaaatgtgaagcaaatgcttgccaaaacgtatccttgacaaggtatggaaccttgtactcgctgcaggtgttcttgatgatggccagaatatcgggataatggtgctgcgacacgttggggaacagatggtgcacagcctggtagttcaagctgccagtgatgctggtccagaggtgcgaatcgtgtgcgtaatcctgcgtagtctcgacctgcatagctgcccagtccttttggatgatcccgttctcgtcaggcaacggccactgaacttcctcaacaacgtggttcgcctggaaggtcagcgccagccagtaagacgacaccatgtccgcgaccgtgaacaagagcagcaccttgcccaggggcagatactgcaggggaacaatcaggcgataccagacaaagaaagccttgccgccccagaacatcacagtgtgccatgtcgagatgggattgacacgaatagcgtcattggtcttgacaaagtacaaaatgttgatgtcctgaatgcgcaccttgaacgccagcagtccgtacaggaaaggaacaaacatgtgctggttgatgtggttgacaaaccacttttggttgggcttgatacgacgaacatcgggctcagacgtcgacacgtcgggatctgctccagcaatgttggtgtaggggtgatggccgagcatatgttggtacatccacaccaggtacgatgctccgttgaaaaagtcgtgcgtggctcccagaatcttccagacagtggggttgtgggtcactgaaaagtgagacgcatcatgaagagggttgagtccgacttgtgcgcacgcaaatcccatgatgattgcaaacaccacctgaagccatgtgcgttcgacaacgaaaggcacaaagagctgcgcgtagtaggaagcgatcaaggatccaaagataagagcgtatcgtccccagatctctggtctattcttgggatcaatgttccgatccgtaaagtagccctcgactctcgtcttgatggttttgtggaacaccgttggctccgggaagatgggcagctcattcgagaccagtgtaccgacatagtacttcttcataatggcatctgcagccccaaacgcgtgatacatctcaaagaccggagtaacatctcggccagctccgagcaggagagtgtccactccaccaggatggcggctcaagaactttgtgacatcgtacaccctgccgcggatggccaagagtaggtcgtccttggtgttatgggccgccagctcttcccaggtgaaggtttttccttggtccgttcccatgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgca

SEQ ID NO: 105 - DNA, 7769 bp, Artificial Sequence
  sequence of pZuFmEgD9ES
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagc

SEQ ID NO: 106 - DNA, 7771 bp, Artificial Sequence
  sequence of pZuFmEgD9E
catggaggtggtgaatgaaatagtctcaattgggcaggaagttttacccaaccagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtac

SEQ ID NO: 107 - DNA, 39 bp, Artificial Sequence
  sequence of the SMART(TM) IV oligonucleotide
aagcagtggtatcaacgcagagtggccattacggccggg

SEQ ID NO: 108 - DNA, 59 bp, Artificial Sequence
  sequence of the CDSIII/3' PCR primer
  misc_feature (28)..(57)
  misc_feature (28)..(57): thymidine (dT); see BD Biosciences Clontech's SMART cDNA technology
  misc_feature (59)..(59): n is a, c, g, or t
attctagaggccgaggcggccgacatgttttttttttttttttttttttttttttttvn

SEQ ID NO: 109 - DNA, 23 bp, Artificial Sequence
  sequence of 5'-PCR primer
aagcagtggtatcaacgcagagt

SEQ ID NO: 110 - DNA, 7779 bp, Artificial Sequence
  sequence of pFBAIN-389Elo
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggctgcggtgatagaggtcgccaacgagtttgtagccatcacggcagaaacgctccccaaagttgactatcaacgactatggcgagacatttacagttgtgagctactgtatttctccattgccttcgtgatcttgaagtttacgttgggcgagttgagcgacagcggaaaaaagattttgagagtgttgttcaagtggtacaatctcttcatgtccgtgttctccttggtgtctttcctttgcatgggctatgccatttataccgtgggcctatactctaacgaatgcgacagggctttcgacaactcgttgttccgctttgcaacaaaggtgttctactacagtaagtttttggagtacatcgactctttttatcttccgctcatggccaagccgctgtctttcctgcaattcttccatcacttgggagcccccatggacatgtggctctttgtccaatattctggggaatctatttggatctttgtgtttttgaatgggttcattcactttgttatgtacgggtactactggactcggctgatgaagttcaatttcccaatgcccaagcagttgattaccgcgatgcagatcacgcagttcaacgttggtttctacctcgtgtggtggtacaaagatattccctgctaccgaaaggatcccatgcgaatgttggcctggatcttcaattactggtatgttgggactgtcttgctgctgttcattaatttcttcgtcaaatcctatgtgttcccaaagccgaagactgcagataaaaaggtccaataggc

SEQ ID NO: 111 - DNA, 1504 bp, Eutreptiella sp. CCMP389
  misc_feature (1487)..(1487): n is a, c, g, or t
tccatttcgcccgtcaagccagagtggccattacggctggtcggacacaacatggctgcggtgatagaggtcgccaacgagtttgtagccatcacggcagaaacgctccccaaagttgactatcaacgactatggcgagacatttacagttgtgagctactgtatttctccattgccttcgtgatcttgaagtttacgttgggcgagttgagcgacagcggaaaaaagattttgagagtgttgttcaagtggtacaatctcttcatgtccgtgttctccttggtgtctttcctttgcatgggctatgccatttataccgtgggcctatactctaacgaatgcgacagggctttcgacaactcgttgttccgctttgcaacaaaggtgttctactacagtaagtttttggagtacatcgactctttttatcttccgctcatggccaagccgctgtctttcctgcaattcttccatcacttgggagcccccatggacatgtggctctttgtccaatattctggggaatctatttggatctttgtgtttttgaatgggttcattcactttgttatgtacgggtactactggactcggctgatgaagttcaatttcccaatgcccaagcagttgattaccgcgatgcagatcacgcagttcaacgttggtttctacctcgtgtggtggtacaaagatattccctgctaccgaaaggatcccatgcgaatgttggcctggatcttcaattactggtatgttgggactgtcttgctgctgttcattaatttcttcgtcaaatcctatgtgttcccaaagccgaagactgcagataaaaaggtccaatagctgcacacacacaattatgcagctccccaccactttctccccaaaacagccagccagcccccttcccatgaaacaagaacctaccccctccctgctcctctttttttaatctcttattccaccatacacttgatgacaacagttgccgtgcagtggagctatgtggtgcatgctgcaatgcactggggcatcatattaagattattgttattagtggtgcccttgcttctctgctttgtgcccctggtaccagggtgcacccatgatgcagtacacaagttgttcaatgtgtgcactgtggtattctctgaattccttgaggagccatttagtttaaccaagcatgactcggctggattggctcgaggtcattgcggaagcaaaagttttgcgaggcagctgccgaaggtgctgctaagttcggcttcaaactggcctttgcacacccaggtacccagggattccaagtctcatggctggcatattttaggtttcatgcatccgcagtggcgtttatgcaaggcacagacgtttatatttatggatatgcgagtgaaggttggcttgccagcattggcatcgcctgcctgcatactgagttttgttgtaaaagtacaaactcagtatcaacaatacaatttttntttgaaaaaaaaaaaaa

SEQ ID NO: 112 - DNA, 20 bp, Artificial Sequence
  sequence of degenerate primer EuEF3
  misc_feature (3)..(3): n is a, c, g, or t
ytncarttyttycaycaytt

SEQ ID NO: 113 - protein, 7 aa, Artificial Sequence
  deduced amino acid sequence of the nucleotide sequence of degenerate primer EuEF3
LQFFHHL

SEQ ID NO: 114 - DNA, 20 bp, Artificial Sequence
  the nucleotide sequence of degenerate primer EuER3
ttraaytgdatdatytgcat

SEQ ID NO: 115 - protein, 7 aa, Artificial Sequence
  deduced amino acid sequence of the nucleotide sequence of degenerate primer EuER3
MQIIQFN

SEQ ID NO: 116 - DNA, 22 bp, Artificial Sequence
  sequence of 389Elo-5-1 primer
gaatgaacccattcaaaaacac

SEQ ID NO: 117 - DNA, 22 bp, Artificial Sequence
  sequence of 389Elo-5-2 primer
gatccaaatagattccccagaa

SEQ ID NO: 118 - DNA, 22 bp, Artificial Sequence
  sequence of DNR CDS 5'-2 primer
caacgcagagtggccattacgg

SEQ ID NO: 119 - DNA, 406 bp, Eutreptiella sp. CCMP389
  misc_feature (1)..(406): the sequence of the Eutreptiella sp. CCMP389 (E389D9e) 5' cDNA fragment #1
  misc_feature (1)..(406): sequence of the Eutreptiella sp. CCMP389 (E389D9e) 5' cDNA fragment #1
atggcgagacatttacagttgtgagctactgtatttctccattgccttcgtgatcttgaagtttacgttgggcgagttgagcgacagcggaaaaaagattttgagagtgttgttcaagtggtacaatctcttcatgtccgtgttctccttggtgtctttcctttgcatgggctatgccatttataccgtgggcctatactctaacgaatgcgacagggctttcgacaactcgttgttccgctttgcaacaaaggtgttctactacagtaagtttttggagtacatcgactctttttatcttccgctcatggccaagccgctgtctttcctgcaattcttccatcacttgggagcccccatggacatgtggctctttgtccaatattctggggaatctatttggatc

SEQ ID NO: 120 - DNA, 21 bp, Artificial Sequence
  sequence of 389Elo-5-4 primer
gtaaacttcaagatcacgaag

SEQ ID NO: 121 - DNA, 197 bp, Eutreptiella sp. CCMP389
  misc_feature (1)..(197): is the sequence of the Eutreptiella sp. CCMP389 (E389D9e) 5' cDNA fragment #2
  misc_feature (1)..(197): sequence of the Eutreptiella sp. CCMP389 (E389D9e) 5' cDNA fragment #2
tccatttcgcccgtcaagccagagtggccattacggctggtcggacacaacatggctgcggtgatagaggtcgccaacgagtttgtagccatcacggcagaaacgctccccaaagttgactatcaacgactatggcgagacatttacagttgtgagctactgtatttctccattgccttcgtgatcttgaagtttac

SEQ ID NO: 122 - DNA, 22 bp, Artificial Sequence
  sequence of 389Elo-3-1 primer
gttcattcactttgttatgtac

SEQ ID NO: 123 - DNA, 22 bp, Artificial Sequence
  sequence of 389Elo-3-2 primer
ctggactcggctgatgaagttc

SEQ ID NO: 124 - DNA, 920 bp, Eutreptiella sp. CCMP389
  misc_feature (1)..(920): is the nucleotiden sequence of the Eutreptiella sp. CCMP389 (E389D9e) 3' cDNA fragment
ctggactcggctgatgaagttcaatttcccaatgcccaagcagttgattaccgcgatgcagatcacgcagttcaacgttggtttctacctcgtgtggtggtacaaagatattccctgctaccgaaaggatcccatgcgaatgttggcctggatcttcaattactggtatgttgggactgtcttgctgctgttcattaatttcttcgtcaaatcctatgtgttcccaaagccgaagactgcagataaaaaggtccaatagctgcacacacacaattatgcagctccccaccactttctccccaaaacagccagccagcccccttcccatgaaacaagaacctaccccctccctgctcctctttttttaatctcttattccaccatacacttgatgacaacagttgccgtgcagtggagctatgtggtgcatgctgcaatgcactggggcatcatattaagattattgttattagtggtgcccttgcttctctgctttgtgcccctggtaccagggtgcacccatgatgcagtacacaagttgttcaatgtgtgcactgtggtattctctgaattccttgaggagccatttagtttaaccaagcatgactcggctggattggctcgaggtcattgcggaagcaaaagttttgcgaggcagctgccgaaggtgctgctaagttcggcttcaaactggcctttgcacacccaggtacccagggattccaagtctcatggctggcatattttaggtttcatgcatccgcagtggcgtttatgcaaggcacagacgtttatatttatggatatgcgagtgaaggttggcttgccagcattggcatcgcctgcctgcatactgagttttgttgtaaaagtacaaactcagtatcaacaatacaatttttktttgaaaaaaaaaaaaa

SEQ ID NO: 125 - DNA, 1504 bp, Eutreptiella sp. CCMP389; identical to SEQ ID NO: 111
  misc_feature (1)..(1504): the nucleotide sequence of the Eutreptiella sp. CCMP389 (E389D9e) complete assembled contig
  misc_feature (1)..(1504): sequence of the Eutreptiella sp. CCMP389 (E389D9e) complete assembled contig

SEQ ID NO: 126 - DNA, 792 bp, Eutreptiella sp. CCMP389
atggctgcggtgatagaggtcgccaacgagtttgtagccatcacggcagaaacgctccccaaagttgactatcaacgactatggcgagacatttacagttgtgagctactgtatttctccattgccttcgtgatcttgaagtttacgttgggcgagttgagcgacagcggaaaaaagattttgagagtgttgttcaagtggtacaatctcttcatgtccgtgttctccttggtgtctttcctttgcatgggctatgccatttataccgtgggcctatactctaacgaatgcgacagggctttcgacaactcgttgttccgctttgcaacaaaggtgttctactacagtaagtttttggagtacatcgactctttttatcttccgctcatggccaagccgctgtctttcctgcaattcttccatcacttgggagcccccatggacatgtggctctttgtccaatattctggggaatctatttggatctttgtgtttttgaatgggttcattcactttgttatgtacgggtactactggactcggctgatgaagttcaatttcccaatgcccaagcagttgattaccgcgatgcagatcacgcagttcaacgttggtttctacctcgtgtggtggtacaaagatattccctgctaccgaaaggatcccatgcgaatgttggcctggatcttcaattactggtatgttgggactgtcttgctgctgttcattaatttcttcgtcaaatcctatgtgttcccaaagccgaagactgcagataaaaaggtccaatag

SEQ ID NO: 127 - protein, 263 aa, Eutreptiella sp. CCMP389
MAAVIEVANEFVAITAETLPKVDYQRLWRDIYSCELLYFSIAFVILKFTLGELSDSGKKILRVLFKWYNLFMSVFSLVSFLCMGYAIYTVGLYSNECDRAFDNSLFRFATKVFYYSKFLEYIDSFYLPLMAKPLSFLQFFHHLGAPMDMWLFVQYSGESIWIFVFLNGFIHFVMYGYYWTRLMKFNFPMPKQLITAMQITQFNVGFYLVWWYKDIPCYRKDPMRMLAWIFNYWYVGTVLLLFINFFVKSYVFPKPKTADKKVQ

SEQ ID NO: 128 - DNA, 7222 bp, Artificial Sequence
  sequence of pFBAIN-MOD-1
catggatccaggcctgttaacggccattacggcctgcaggatccgaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtac

SEQ ID NO: 129 - DNA, 200 bp, Eutreptiella sp. CCMP389
  misc_feature (1)..(200): the nucleotide sequence of the Eutreptiella sp. CCMP389 (E389D9e) internal cDNA fragment
  misc_feature (1)..(200): sequence of the Eutreptiella sp. CCMP389 (E389D9e) internal cDNA fragment
ttacagttcttccaccacttgggagcccccatggacatgtggctctttgtccaatattctggggaatctatttggatctttgtgtttttgaatgggttcattcactttgttatgtacgggtactactggactcggctgatgaagttcaatttcccaatgcccaagcagttgattaccgcgatgcagatcatccaattcaa

SEQ ID NO: 130 - protein, 13 aa, Artificial Sequence
  motif
  misc_feature (3)..(3): Xaa can be any naturally occurring amino acid
  MISC_FEATURE (4)..(4): X = L or F
  misc_feature (5)..(8): Xaa can be any naturally occurring amino acid
  misc_feature (10)..(11): Xaa can be any naturally occurring amino acid
YNXXXXXXSXXSF

SEQ ID NO: 131 - protein, 15 aa, Artificial Sequence
  motif
  misc_feature (3)..(3): Xaa can be any naturally occurring amino acid
  misc_feature (6)..(7): Xaa can be any naturally occurring amino acid
  MISC_FEATURE (8)..(8): X = E or D
  misc_feature (10)..(10): Xaa can be any naturally occurring amino acid
  MISC_FEATURE (12)..(12): X = T or S
  misc_feature (13)..(14): Xaa can be any naturally occurring amino acid
FYXSKXXXYXDXXXL

SEQ ID NO: 132 - protein, 9 aa, Artificial Sequence
  motif
  MISC_FEATURE (2)..(2): X = Q or H
  misc_feature (3)..(3): Xaa can be any naturally occurring amino acid
  misc_feature (7)..(7): Xaa can be any naturally occurring amino acid
LXXFHHXGA

SEQ ID NO: 133 - protein, 14 aa, Artificial Sequence
  motif
  misc_feature (3)..(3): Xaa can be any naturally occurring amino acid
  misc_feature (6)..(12): Xaa can be any naturally occurring amino acid
  MISC_FEATURE (13)..(13): X = K or R or N
MYXYYXXXXXXXXF

SEQ ID NO: 134 - protein, 8 aa, Artificial Sequence
  motif
  misc_feature (2)..(2): Xaa can be any naturally occurring amino acid
  MISC_FEATURE (4)..(4): X = I or L or M
  misc_feature (6)..(7): Xaa can be any naturally occurring amino acid
KXLXTXXQ

SEQ ID NO: 135 - protein, 7 aa, Artificial Sequence
  motif
  misc_feature (2)..(2): Xaa can be any naturally occurring amino acid
  misc_feature (6)..(6): Xaa can be any naturally occurring amino acid
WXFNYXY

SEQ ID NO: 136 - protein, 9 aa, Artificial Sequence
  motif
  misc_feature (2)..(2): Xaa can be any naturally occurring amino acid
  misc_feature (4)..(4): Xaa can be any naturally occurring amino acid
  misc_feature (6)..(7): Xaa can be any naturally occurring amino acid
YXGXVXXLF

What is claimed is:

1. A method for producing at least one polyunsaturated fatty acid in a soybean cell comprising:
    (a) transforming a soybean cell with a first recombinant construct comprising an isolated polynucleotide comprising:
        (i) a nucleotide sequence encoding a polypeptide having delta-9 elongase activity, wherein the polypeptide has at least 70% amino acid identity, based on the Clustal V method of alignment, when compared to an amino acid sequence as set forth in SEQ ID NO:5;
        (ii) a nucleotide sequence encoding a polypeptide having delta-9 elongase activity, wherein the nucleotide sequence has at least 70% sequence identity, based on the BLASTN method of alignment, when compared to a nucleotide sequence as set forth in SEQ ID NO:4 or SEQ ID NO:90;
        (iii) a nucleotide sequence encoding a polypeptide having delta-9 elongase activity, wherein the nucleotide sequence hybridizes with a nucleotide sequence as set forth in SEQ ID NO:4, SEQ ID NO:90 or SEQ ID NO:126 under the following stringent hybridization conditions:0.1.times.SSC, 0.1% SDS, 65.degree. C. and washed with 2.times.SSC, 0.1% SDS followed by 0.1.times.SSC, 0.1% SDS: or
        (iv) a complement of the nucleotide sequence of (i), (ii) or (iii), wherein the complement and the nucleotide sequence consist of the same number of nucleotides and are 100% complementary;
    operably linked to at least one regulatory sequence and at least one additional recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-12 desaturase, a delta-15 desaturase, a delta- 17 desaturase, a delta-8 desaturase, a $C_{14/16}$ elongase, a $C_{16/18}$ elongase, a $C_{18/20}$ elongase and a $C_{20/22}$ elongase;

(b) regenerating a soybean plant from the transformed soybean cell of step (a); and (c) selecting those seeds obtained from the plants of step (b) having an altered level of polyunsaturated fatty acids when compared to the level in seeds obtained from a nontransformed soybean plant.

2. The method of claim 1, wherein the polypeptide of (a)(i) has at least 80% amino acid identity, based on the Clustal V method of alignment, when compared to an amino acid sequence as set forth in SEQ ID NO:5.

3. The method of claim 2, wherein the polypeptide of (a)(i) has at least 90% amino acid identity, based on the Clustal V method of alignment, when compared to an amino acid sequence as set forth in SEQ ID NO:5.

4. The method of claim 3, wherein the polypeptide of (a)(i) has at least 95% amino acid identity, based on the Clustal V method of alignment, when compared to an amino acid sequence as set forth in SEQ ID NO:5.

5. The method of claim 4, wherein the polypeptide of (a)(i) comprises the amino acid sequence set forth in SEQ ID NO:5.

6. The method of claim 1, wherein the nucleotide sequence of (a)(ii) has at least 80% sequence identity, based on the BLASTN method of alignment, when compared to a nucleotide sequence as set forth in SEQ ID NO:4 or SEQ ID NO:90.

7. The method of claim 6, wherein the nucleotide sequence of (a)(ii) has at least 90% sequence identity, based on the BLASTN method of alignment, when compared to a nucleotide sequence as set forth in SEQ ID NO:4 or SEQ ID NO:90.

8. The method of claim 7, wherein the nucleotide sequence of (a)(ii) has at least 95% sequence identity, based on the BLASTN method of alignment, when compared to a nucleotide sequence as set forth in SEQ ID NO:4 or SEQ ID NO:90.

9. The method of claim 8, wherein the nucleotide sequence of (a)(ii) comprises the nucleotide sequence set forth in SEQ ID NO:4 or SEQ ID NO:90.

10. An oilseed plant comprising:

(a) a first recombinant construct comprising an isolated polynucleotide comprising:
  (i) a nucleotide sequence encoding a polypeptide having delta-9 elongase activity, wherein the polypeptide has at least 70% amino acid identity, based on the Clustal V method of alignment, when compared to an amino acid sequence as set forth in SEQ ID NO:5;
  (ii) a nucleotide sequence encoding a polypeptide having delta-9 elongase activity, wherein the nucleotide sequence has at least 70% sequence identity, based on the BLASTN method of alignment, when compared to a nucleotide sequence as set forth in SEQ ID NO:4 or SEQ ID NO:90;
  (iii) a nucleotide sequence encoding a polypeptide having delta-9 elongase activity, wherein the nucleotide sequence hybridizes with a nucleotide sequence as set forth in SEQ ID NO:4, SEQ ID NO:90 or SEQ ID NO:126 under the following stringent hybridization conditions: 0.1.times.SSC, 0.1% SDS, 65.degree. C. and washed with 2.times.SSC, 0.1% SDS followed by 0.1.times.SSC, 0.1% SDS; or
  (iv) a complement of the nucleotide sequence of (i), (ii) or (iii), wherein the complement and the nucleotide sequence consist of the same number of nucleotides and are 100% complementary;
operably linked to at least one regulatory sequence; and (b) at least one additional recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-12 desaturase, a delta-15 desaturase, a delta-17 desaturase, a delta-8 desaturase, a $C_{14/16}$ elongase, a $C_{16/18}$ elongase, a $C_{18/20}$ elongase and a $C_{20/22}$ elongase.

11. The oilseed plant of claim 10, wherein the oilseed plant is selected from the group consisting of soybean, Brassica species, sunflower, maize, cotton, flax and safflower.

12. The oilseed plant of claim 10 wherein the oilseed plant is selected from the group consisting of soybean, Brassica species, sunflower, maize, cotton, flax, and safflower and further wherein the polyunsaturated fatty acid is at least one selected from the group consisting of arachidonic acid, eicosadienoic acid, eicosapentaenoic acid, eicosatetraenoic acid, eicosatrienoic acid, dihomo-gamma-linolenic acid, docosapentaenoic acid and docosahexaemoic acid.

13. A seed obtained from the oilseed plant of claim 10.

14. The oilseed plant of claim 10, wherein the polypeptide of (a)(i) has at least 80% amino acid identity, based on the Clustal V method of alignment, when compared to an amino acid sequence as set forth in SEQ ID NO:5.

15. The oilseed plant of claim 14, wherein the polypeptide of (a)(i) has at least 90% amino acid identity, based on the Clustal V method of alignment, when compared to an amino acid sequence as set forth in SEQ ID NO:5.

16. The oilseed plant of claim 15, wherein the polypeptide of (a)(i) has at least 95% amino acid identity, based on the Clustal V method of alignment, when compared to an amino acid sequence as set forth in SEQ ID NO:5.

17. The oilseed plant of claim 16, wherein the polypeptide of (a)(i) comprises the amino acid sequence set forth in SEQ ID NO:5.

18. The oilseed plant of claim 10, wherein the nucleotide sequence of (a)(ii) has at least 80% sequence identity, based on the BLASTN method of alignment, when compared to a nucleotide sequence as set forth in SEQ ID NO:4 or SEQ ID NO:90.

19. The oilseed plant of claim 18, wherein the nucleotide sequence of (a)(ii) has at least 90% sequence identity, based on the BLASTN method of alignment, when compared to a nucleotide sequence as set forth in SEQ ID NO:4 or SEQ ID NO:90.

20. The oilseed plant of claim 19, wherein the nucleotide sequence of (a)(ii) has at least 95% sequence identity, based on the BLASTN method of alignment, when compared to a nucleotide sequence as set forth in SEQ ID NO:4 or SEQ ID NO:90.

21. The oilseed plant of claim 20, wherein the nucleotide sequence of (a)(ii) comprises the nucleotide sequence set forth in SEQ ID NO:4 or SEQ ID NO:90.

* * * * *